United States Patent 7,745,391 (HUMAN THROMBOSPONDIN POLYPEPTIDE) - sequence listing, part 130

SEQ ID NO: 358308 - DNA, 3843 bp, Homo sapiens
ggctgttttcccactgtcccttcttcgggcagtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctgtattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaaaaaaaaaaaaaaaaaaaaaaaaaaaaaaaaaaaaaaaaaaaaaaaaaaaaaaaaaaaaaaaaaaagaggggggggggggaaaaagaataaccccgcgagaggggggacgccaaagagagagagagagcgcgcgcacacccaagtgtgtgtgtgtgtgtgaaaagagggggggcccacaaagagagagggagggcgtataataaaacgagagagagagagaggggcgggcgggtataacaaacacagcggaggaggaggggagaaaaaagcggagaaaggcggggacatatctggggagaagagggaccactattattattgggggggggagggaaacaaattgtgggggagaaaacttccctataggagaataatattaaagacgacttgagggggaatatattataaaaattttagcgaagctgattattagggggaaa

SEQ ID NO: 358309 - DNA, 3668 bp, Homo sapiens
ggctgttttcccactgtcccttcttcgggcagtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctgtattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaaaaaaaaaaaaaaaaaaaaaaaaaaaaaaaaaaaaaaaaaaaaaaaaaaaaaaaaaaaaaaaaaaagaaaaaaaaaaaaaaaaacaacacagaagaagagagaaggacaaaacagagcgtaagcagaagaggaggagctggcagtcgcgaaggagcgagccacatctcgtgaaccagcggccgggcgaccaccgcgccacacccgcacaccagcgcgcgattacgctcaccccccacgcagcggcggacagccgccaacgcgcgcc

SEQ ID NO: 358310 - DNA, 2188 bp, Homo sapiens
gccccctcttctcccctcccccaagccagcacctggtgccccggcgggtcgtgcggcgcggcgctccgcgagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctaggagaaaattaaacacctgggggaggaaaacaggaagctgttgtggcacctgtcaccacctgggggatcacgaggcagctggtgtcttgggctctgcagaaatatacagcctctgcagacactgcttctgaatgaacgggctggagtttccttgggatcctgaactcatattggattctctacctaccatcttggacaattcatgtaggaaaacaaatcctcatttgttcaaacaatagatgaaaattattaaagttttgacacatattaaat

SEQ ID NO: 358311 - DNA, 3508 bp, Homo sapiens
  misc_feature (36)..(36): n is a, c, g, or t
  misc_feature (101)..(101): n is a, c, g, or t
  misc_feature (169)..(169): n is a, c, g, or t
acagatgaatgggagagccagccgagaaatctaaantgcctcgcatccccagcagtttgctaaaggaggtagtggctggacaggttaagacaccctcccanccccccagcctcctgcagtactcagggtaaccattaggcaccttattctgcagccaccagtggggcantgttgccaagagggtaccaagaggagaatcctgcagccttgagctgtgcaactgataacgaactacagatgggatggacgccatcttacctgatgctggccagtatatcatgacatggagaactccccgctattcctgagaaacttggactttgactcaacagaaagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctgtattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaatggaactgatgtgggtatga

SEQ ID NO: 358312 - DNA, 463 bp, Homo sapiens
gggttttgctcagtgcagagagcccagcattacatcaacatgcccgtgcagttcaaaccgaagtccgcaggcaaatttgaagctttgcttgtcattcaaacagatgaaggtacccagttacagatggcagaaactgttcttagcgtacagaaaatgtaatattagtatatggctgcttttaaaagtttgtgtttggttgtaaagcagccctaagattgtaaatcaatgtgtcctgccagctgagattactggagtccacaagagtgaggatgcttctcttgtcaagcagaaatatacagcctctgcagacactgcttctgaatgaacgggctggagtttccttgggatcctgaactcatattggattctctacctaccatcttggacaattcatgtaggaaaacaaatcctcatttgttcaaacaatagatgaaaattattaaagttttgacacatattaaat

SEQ ID NO: 358313 - DNA, 3113 bp, Homo sapiens
tccttgctcttctccatgacactaggactcccttggtcttgaagctggagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctgtattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaa

SEQ ID NO: 358314 - DNA, 3403 bp, Homo sapiens
ggctgttttcccactgtcccttcttcgggcagtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctgtattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaa

SEQ ID NO: 358315 - DNA, 3450 bp, Homo sapiens
  misc_feature (36)..(36): n is a, c, g, or t
  misc_feature (101)..(101): n is a, c, g, or t
  misc_feature (169)..(169): n is a, c, g, or t
acagatgaatgggagagccagccgagaaatctaaantgcctcgcatccccagcagtttgctaaaggaggtagtggctggacaggttaagacaccctcccanccccccagcctcctgcagtactcagggtaaccattaggcaccttattctgcagccaccagtggggcantgttgccaagagggtaccaagaggagaatcctgcagccttgagctgtgcaactgataacgaactacagatgggatggacgccatcttacctgatgctggccagtatatcatgacatggagaactccccgctattcctgagaaacttggactttgactcaacagaaagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcaagtgttcttgaggtggaaagcccaggtgcagcctctgaggcagtgagtggcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctgtattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaa

SEQ ID NO: 358316 - DNA, 2088 bp, Homo sapiens
gccccctcttctcccctcccccaagccagcacctggtgccccggcgggtcgtgcggcgcggcgctccgcgagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctaaatatacagcctctgcagacactgcttctgaatgaacgggctggagtttccttgggatcctgaactcatattggattctctacctaccatcttggacaattcatgtaggaaaacaaatcctcatttgttcaaacaatagatgaaaattattaaagttttgacacatattaaat

SEQ ID NO: 358317 - DNA, 2083 bp, Homo sapiens
gccccctcttctcccctcccccaagccagcacctggtgccccggcgggtcgtgcggcgcggcgctccgcgagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgtgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgatcatttttaaaattccttcacactgtaatataatgtgttttatattcttatgtagtaaaacaacataactcagatttctacaggagacagtggtaatattaagattgtcatctgtaatagataacaataaaactggatgaacataaa

SEQ ID NO: 358318 - DNA, 564 bp, Homo sapiens
gggaagtgcgcaggcgcgggtcggggtgggtgtggaggtggcaacgactccccgggtaggtcgcccccagtcaggggtcatactgctcactgtcccgggtcgcttagggagttcgtggagcgggaggtgatcgacttcgcccgacggaatccaggggtcgtaatatatgtaaactcgcgtccgtgctgcgtgcccagagtagtggccgaataccgatgcggctgagttcctcggcgaaggagcagggccctgctggtactccattgttgctctgcctcagaagcacatagctattgccattcatcctccgcagccggctgggcagtgccaccaagccattggacactggcctgagactgtctgcagttgcaccgcagatcctcctgcccggctggcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttg

SEQ ID NO: 358319 - DNA, 1012 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacaggacccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtcaca

SEQ ID NO: 358320 - DNA, 239 bp, Homo sapiens
tctccgctcaaccgaacactctcgtctcgcggcgccagggagttcgtggagcgggaggtgatcgacttcgcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttg

SEQ ID NO: 358321 - DNA, 1111 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacaggacccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtcacaaacttccttatctctctattcacacccccaatatcctctctctcctcttttctcgccaaaacggggcggcccacaggagccccatataacactcgctcg

SEQ ID NO: 358322 - DNA, 916 bp, Homo sapiens
gggaagtgcgcaggcgcgggtcggggtgggtgtggaggtggcaacgactccccgggtaggtcgcccccagtcaggggtcatactgctcactgtcccgggtcgcttagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacaggacccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtcaca

SEQ ID NO: 358323 - DNA, 903 bp, Homo sapiens
ctgacggcctagggtgcgaggctgggtggtctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacaggacccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtcaca

SEQ ID NO: 358324 - DNA, 1033 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacaggacccttgtttttaatcaatgtatatgatctcaaccggagagttgagctggtctgagatctgatgtttttggacaccctgcttcggagtctctggaggcttggcttttggtgaccgtttaccggttactccggccttcaaaaacccctttggggaaggaggcggcttccctttagagccgtgtaaaatagaaagtttacgcgctccacccattcctcccttgg

SEQ ID NO: 358325 - DNA, 898 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccgtgcctgcttctgggggcagtgaccttgtgaaccactcatttttatgcaagtggcatccctaaaacctgagatgaggaagacttcaagggttttacaggacccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtcaca

SEQ ID NO: 358326 - DNA, 760 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggacactggcctgagactgtctgcagttgcaccgcagatcctcctgcccggctggcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttg

SEQ ID NO: 358327 - DNA, 887 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggatgcggctgagttcctcggcgaaggagcagggccctgctggtactccattgttgctctgcctcagaagcacatagctattgccattcatcctccgcagccggctgggcagtgccaccaagccattggacactggcctgagactgtctgcagttgcaccgcagatcctcctgcccggctggcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttg

SEQ ID NO: 358328 - DNA, 1016 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggatgcggctgagttcctcggcgaaggagcagggccctgctggtactccattgttgctctgcctcagaagcacatagctattgccattcatcctccgcagccggctgggcagtgccaccaagccattggtcagctcagccggtggcggtgggggcggtgggggtggtggggctggggctccctccccagggatgatctggagacagctgccctccaggcccccagcccctcatcatcaccctcatcttcctctccaggacactggcctgagactgtctgcagttgcaccgcagatcctcctgcccggctggcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttg

SEQ ID NO: 358329 - DNA, 892 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggacactggcctgagactgtctgcagttgcaccgcagatcctcctgcccggctggcccgacccaacacgagccacacgggccacacggtgactgctgcggctctgagtgaagctgccagagccctcctcagtggcacgctccgtgaagaagtagtacaccttgtcatcatcacccactgcactggccttgctctcccgcacgaggacggagaacacaaactccgcatctgtgggtcaggcagtttgagaggcttttgagacaggctggggattcctttccctcactctgaggctgacccctcacttgacaacacacaggaatggaatggacaggctcacctggggatttgggggtg

SEQ ID NO: 358330 - DNA, 715 bp, Homo sapiens
ctgacggcctagggtgcgaggctgggtggtctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcagtggcaccccttcaccaacaagccgaccacgttccgcgggctacgcccccgagaggttcaggatcctgccccagcccaggacactggcctgagactgtctgcagttgcaccgcagatcctcctgcccggctggcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttg

SEQ ID NO: 358331 - DNA, 498 bp, Homo sapiens
tttgccatgttgcccaggctggtctccaattcctgagctcaagcaatccacctacctcagcctcccgaagtgctgggattacaggcgtgagccactgtactcagccaggtttgaattctggtccagtttcttaatagctgaataagtttgagcaatttacttacactccctgggcttcagagaggtccctcatggggataataataatggcacctttctcataagaatgctgtgacagtagatgacatcatgcatagaagtatttagatcagtgtctggcacacagtaaatacttaatacatcttagctgtgatgattaacttttgttctttcttcagatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttg

SEQ ID NO: 358332 - DNA, 437 bp, Homo sapiens
gggaagtgcgcaggcgcgggtcggggtgggtgtggaggtggcaacgactccccgggtaggtcgcccccagtcaggggtcatactgctcactgtcccgggtcgcttagggagttcgtggagcgggaggtgatcgacttcgcccgacggaatccaggggtcgtaatatatgtaaactcgcgtccgtgctgcgtgcccagagtagtggccgaataccgacactggcctgagactgtctgcagttgcaccgcagatcctcctgcccggctggcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttg

SEQ ID NO: 358333 - DNA, 1392 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacaggacccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtcacaaaaacaccacaaaacacaaaacacaaaaaaacacccggggcccaaatagcaggggggggacacaacgcgatagaaggggccaggggcaacgggtccgcgacccacgtttttgcccagcggggaaacacggggggccccataaggggggcgaaaattcgaaacacgggactcaccctactctgctgcactctgctagccgccgagaccccgacatcgggcgggttttttgtgtgaacacagcagggcgctcagcaaggacatatctggagtcggtgctagcttccgcatacactatccacccaagaacgctggttggcgcagtccgaaatccagacaactatcctgacgcgcggtgctaccaccggaccacccatcagcac

SEQ ID NO: 358334 - DNA, 1124 bp, Homo sapiens
ctgacggcctagggtgcgaggctgggtggtctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccgtgagtggggccgggctcgggctggagggcgggatcaggggctcgacccgctatcctccttctcgcttggtcgcaccggccagcttccacccactctcacccctcttctgccagttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacaggacccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtcaca

SEQ ID NO: 358335 - DNA, 967 bp, Homo sapiens
ctgacggcctagggtgcgaggctgggtggtctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcagtggcaccccttcaccaacaagccgaccacgttccgcgggctacgcccccgagaggttcaggatcctgccccagcccaggtgcaagcacagtgaagagttgccccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacaggacccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtcaca

SEQ ID NO: 358336 - DNA, 836 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccagtgcctgcttctgggggcagtgaccttgtgaaccactcatttttatgcaagtggcatccctaaaacctgagatgaggaagacttcaagggttttacaggacccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtcaca

SEQ ID NO: 358337 - DNA, 822 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccggacactggcctgagactgtctgcagttgcaccgcagatcctcctgcccggctggcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttg

SEQ ID NO: 358338 - DNA, 1051 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggatgcggctgagttcctcggcgaaggagcagggccctgctggtactccattgttgctctgcctcagaagcacatagctattgccattcatcctccgcagccggctgggcagtgccaccaagccattggtcagctcagccggtggcggtgggggcggtgggggtggtggggctggggctccctccccagggatgatctggagacagctgccctccaggcccccagcccctcatcatcaccctcatcttcctctccaggacactggcctgagactgtctgcagttgcaccgcagatcctcctgcccggctggcccgacccaccagacctccccacagtggatcctatctcatcctcattgacctctgctccagcccctatgctgtccgcagtttcttgcctcccgattgtccctgcactgaccactgtgtgctcagcgtgaaggctgcatagaagtgtgtacggcttgaggtttcagcatccaggctgcagaccccacgcagtgtctcatacagtg

SEQ ID NO: 358339 - DNA, 922 bp, Homo sapiens
ccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggatgcggctgagttcctcggcgaaggagcagggccctgctggtactccattgttgctctgcctcagaagcacatagctattgccattcatcctccgcagccggctgggcagtgccaccaagccattggacactggcctgagactgtctgcagttgcaccgcagatcctcctgcccggctggcccgacccaccagacctccccacagtggatcctatctcatcctcattgacctctgctccagcccctatgctgtccgcagtttcttgcctcccgattgtccctgcactgaccactgtgtgctcagcgtgaaggctgcatagaagtgtgtacggcttgaggtttcagcatccaggctgcagaccccacgcagtgtctcatacagtg

SEQ ID NO: 358340 - DNA, 531 bp, Homo sapiens
ctgacggcctagggtgcgaggctgggtggtctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccgacactggcctgagactgtctgcagttgcaccgcagatcctcctgcccggctggcccgacccaatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttg

SEQ ID NO: 358341 - DNA, 1294 bp, Homo sapiens
ttttttgtagagacagggtttcgccatgttgcctaggctggtctccaacctggtctcctgggctcaagcgatccgcccgcctcggcctcccacagtgctgggattccaggcgtgagctaccgcgcccggcctatttacttttcttactaagctggggatcaccgtcgccctcggcttggcaggaaggcgggggtgcaagaagaaaagaggtacagaacacccagaggtgccctcgattccgtcttgcacttgcccttctcccaccgtccagcaataaagcgagagaaacaagtgcaggaaactggccggcagtcatgggagaagccaaaaagacaggagttcagtggcatgaccagggctcactgcaaccttgatctgggctcaagtgatcctcctacctcagcttcctgagtagctaggaccacaggtgtgcaccaaccacacccgactaatttttgtagagatgagatcccactatgttacccaggctggtcttgaactcctgggctcaggtgatcatcctgccttggcttcccaaagtactgggattataggcttgagccaccgtgcctggcctgtgatcagaattctcatttttttagtcactaaaaatgctgggggggcactccattctccattatgtgattagttcacattgcatgcttgtatcaaaacatcatatataccccacaaatatatacaaaaaactttaaaattttaagtattaattgctcaggaaaaaattaaaatgctggggtgctgaaatctcaagggccccattacaaaactccttaggaacctcgccctctctctgctgtaaggactggttccagaatgagagaatttaaaagacattccccccccaaaatgttcataatgtcaccccggaaacctgcgaatatgttatattacatgaccagggagaagtaaggttgcagatggcagtaaggttgctaatgggctgaccttaagataaggagatgatcctggattatctgggtggacccaatgtaatcacaagggtccttaactgtggaatagtgaggtggctgagtcagaggcagagtgatgcaatgactgaaagacttaaccagccatcaccggctttgaatacggaagacggtcatgagccagggaatgcaggcaggctctgggagctgaaaaaagcaagaaaatggattctcccctggagcctccagaagggatgcggtcctgccaaccccttgtcagtgagccatttcagatttctgacttccaggactgtaagaaaataaacttgtcttgttttcagcca

SEQ ID NO: 358342 - DNA, 727 bp, Homo sapiens
ttttttgtagagacagggtttcgccatgttgcctaggctggtctccaacctggtctcctgggctcaagcgatccgcccgcctcggcctcccacagtgctgggattccaggcgtgagctaccgcgcccggcctatttacttttcttactaagctggggatcaccgtcgccctcggcttggcaggaaggcgggggtgcaagaagaaaagaggtacagaacacccagaggtgccctcgattccgtcttgcacttgcccttctcccaccgtccagcaataaagcgagagaaacaagtgcaggaaactggccggcagtcatgggagaagccaaaaagacaggtgagcagcgcgtccgcctcccgcgcacagccttggggagccggcgggatccagagcggggctcctctccgcactttgtagctgcgttgctccgctccatgccctgcctcagccactcctcctggttaccaggcaaaaggaaacaccttgagctggccaggagctaccagcgtctgtctacacctgggtgagccgtactggtcgtagtggccccaccctacaaggatgcccttcctacagtattactgatggctgtctaatccggttagctcccagtcactacaccccagcctcccagcgcctgcaggtggattgggttatcctcacatttgagtgaaactcctgcacaccagacactgaatcgagttgtctgggagcatctaactgcaag

SEQ ID NO: 358343 - DNA, 1303 bp, Homo sapiens
gaaaccttggacaatacctggctttcctaggcagaggtccctgcggccttccgcagtgttttttgtccctgggtacttgagattagggagtggtgatgactcttaacaagcatgctgccttcaagcatttgtttaacaaagcacaccttgcacagcccttaagccatttaaccctgagttgacacagcacatgtctcagggagcacagggttgggggtagggttacagattaacagcatcttaaggcagaagaatttttcttacagaacaaaatggagtctcctatgtctacttttttctacacagacacagtaacaatctgatctctctttcttttccccacaggagttcagtggcatgaccagggctcactgcaaccttgatctgggctcaagtgatcctcctacctcagcttcctgagtagctaggaccacaggtgtgcaccaaccacacccgactaatttttgtagagatgagatcccactatgttacccaggctggtcttgaactcctgggctcaggtgatcatcctgccttggcttcccaaagtactgggattataggcttgagccaccgtgcctggcctgtgatcagaattctcatttttttagtcactaaaaatgctgggggggcactccattctccattatgtgattagttcacattgcatgcttgtatcaaaacatcatatataccccacaaatatatacaaaaaactttaaaattttaagtattaattgctcaggaaaaaattaaaatgctggggtgctgaaatctcaagggccccattacaaaactccttaggaacctcgccctctctctgctgtaaggactggttccagaatgagagaatttaaaagacattccccccccaaaatgttcataatgtcaccccggaaacctgcgaatatgttatattacatgaccagggagaagtaaggttgcagatggcagtaaggttgctaatgggctgaccttaagataaggagatgatcctggattatctgggtggacccaatgtaatcacaagggtccttaactgtggaatagtgaggtggctgagtcagaggcagagtgatgcaatgactgaaagacttaaccagccatcaccggctttgaatacggaagacggtcatgagccagggaatgcaggcaggctctgggagctgaaaaaagcaagaaaatggattctcccctggagcctccagaagggatgcggtcctgccaaccccttgtcagtgagccatttcagatttctgacttccaggactgtaagaaaataaacttgtcttgttttcagcca

SEQ ID NO: 358344 - DNA, 427 bp, Homo sapiens
ttactaagctggggatcaccgtcgccctcggcttggcaggaaggcgggggtaggggagcggtgggaaaggggggtgggcgacgactctgatagagggaaaagaggaagggaaagttggggcttactgcagggcaagctccttaggagaaggtggggaggaggaaggagggaggtccaggcccttcttccatcccacgtcctccacttcccaaggtgcaagaagaaaagaggtacagaacacccagaggtgccctcgattccgtcttgcacttgcccttctcccaccgtccagcaataaagcgagagaaacaagtgcaggaaactggccggcagtcatgggagaagccaaaaagacaggtgagcagcgcgtccgcctcccgcgcacaggtgagggctcacttctgcctgtcggcggcggcacacacag

SEQ ID NO: 358345 - DNA, 697 bp, Homo sapiens
ttttttgtagagacagggtttcgccatgttgcctaggctggtctccaacctggtctcctgggctcaagcgatccgcccgcctcggcctcccacagtgctgggattccaggcgtgagctaccgcgcccggcctatttacttttcttactaagctggggatcaccgtcgccctcggcttggcaggaaggcgggggtgcaagaagaaaagaggtacagaacacccagaggtgccctcgattccgtcttgcacttgcccttctcccaccgtccagcaataaagcgagagaaacaagtgcaggaaactggccggcagtcatgggagaagccaaaaagacagccttggggagccggcgggatccagagcggggctcctctccgcactttgtagctgcgttgctccgctccatgccctgcctcagccactcctcctggttaccaggcaaaaggaaacaccttgagctggccaggagctaccagcgtctgtctacacctgggtgagccgtactggtcgtagtggccccaccctacaaggatgcccttcctacagtattactgatggctgtctaatccggttagctcccagtcactacaccccagcctcccagcgcctgcaggtggattgggttatcctcacatttgagtgaaactcctgcacaccagacactgaatcgagttgtctgggagcatctaactgcaag

SEQ ID NO: 358346 - DNA, 1637 bp, Homo sapiens
tgccggaaacagaataatggcgtctcgtagccccaggcgacagcgtggaggggcgggtctgtcgattggatgaacgcagctgagattactcccagccactaaggacgaagaggtggggcggtggcgtcccacgcctcgtgcgacagtgggcggggctttgttgcctgagtaaccgtatgatggtggtggtggtggtgtcttcctgtctcaacgatacctattttctagtgctgagatcctgagacaatgaatcatagtgaaagattcgttttcattgcagagtggtatgatccaaatgcttcacttcttcgacgttatgagcttttattttacccaggggatggatctgttgaaatgcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaaaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggactgttgggaaagatcctgatggctatccgagatgcaggttttgaaatctcagctatgcagatgttcaatatggatcgggttaatgttgaggaattctatgaagtttataaaggagtagtgaccgaatatcatgacatggtgacagaaatgtattctggcccttgtgtagcaatggagattcaacagaataatgctacaaagacatttcgagaattttgtggacctgctgatcctgaaattgcccggcatttacgccctggaactctcagagcaatctttggtaaaactaagatccagaatgctgttcactgtactgatctgccagaggatggcctattagaggttcaatacttcttcaagatcttggataattagtggtgtggaaagtaaagaagtcacaggttgggacatttagacaagagtgaatcacacacgaggaatgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttcaaacaagtgact

SEQ ID NO: 358347 - DNA, 471 bp, Homo sapiens
tccccagacccccaaatctccaatttctcacaagtgaatttaggcaaactaaagaagacatctctgttccgaaattgcccggcatttacgccctggaactctcagagcaatctttggtaaaactaagatccagaatgctgttcactgtactgatctgccagaggatggcctattagaggttcaatacttcttcaagatcttggataattagtggtgtggaaagtaaagaagtcacaggttgggacatttagacaagagtgaatcacacacgaggaatgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttcaaacaagtgact

SEQ ID NO: 358348 - DNA, 1130 bp, Homo sapiens
  misc_feature (1123)..(1123): n is a, c, g, or t
  misc_feature (1125)..(1125): n is a, c, g, or t
  misc_feature (1130)..(1130): n is a, c, g, or t
tgccggaaacagaataatggcgtctcgtagccccaggcgacagcgtggaggggcgggtctgtcgattggatgaacgcagctgagattactcccagccactaaggacgaagaggtggggcggtggcgtcccacgcctcgtgcgacagtgggcggggctttgttgcctgagtaaccgtatgatggtggtggtggtggtgtcttcctgtctcaacgatacctattttctagtgctgagatcctgagacaatgaatcatagtgaaagattcgttttcattgcagagtggtatgatccaaatgcttcacttcttcgacgttatgagcttttattttacccaggggatggatctgttgaaatgcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaaaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggtatgttgaatacacatatattcagtacattttgttaataggagagcaatgtttattttcttgatgtactttatgtatagaaaaataaagtatacttttaataaaaataacacctggtatgcngnccagn

SEQ ID NO: 358349 - DNA, 1470 bp, Homo sapiens
tgccggaaacagaataatggcgtctcgtagccccaggcgacagcgtggaggggcgggtctgtcgattggatgaacgcagctgagattactcccagccactaaggacgaagaggtggggcggtggcgtcccacgcctcgtgcgacagtgggcggggctttgttgcctgagtaaccgtatgatggtggtggtggtggtgtcttcctgtctcaacgatacctattttctagtgctgagatcctgagacaatgaatcatagtgaaagattcgttttcattgcagagtggtatgatccaaatgcttcacttcttcgacgttatgagcttttattttacccaggggatggatctgttgaaatgaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggactgttgggaaagatcctgatggctatccgagatgcaggttttgaaatctcagctatgcagatgttcaatatggatcgggttaatgttgaggaattctatgaagtttataaaggagtagtgaccgaatatcatgacatggtgacagaaatgtattctggcccttgtgtagcaatggagattcaacagaataatgctacaaagacatttcgagaattttgtggacctgctgatcctgaaattgcccggcatttacgccctggaactctcagagcaatctttggtaaaactaagatccagaatgctgttcactgtactgatctgccagaggatggcctattagaggttcaatacttcttcaagatcttggataattagtggtgtggaaagtaaagaagtcacaggttgggacatttagacaagagtgaatcacacacgaggaatgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttcaaacaagtgact

SEQ ID NO: 358350 - DNA, 1606 bp, Homo sapiens
tgccggaaacagaataatggcgtctcgtagccccaggcgacagcgtggaggggcgggtctgtcgattggatgaacgcagctgagattactcccagccactaaggacgaagaggtggggcggtggcgtcccacgcctcgtgcgacagtgggcggggctttgttgcctgagtaaccgtatgatggtggtggtggtggtgtcttcctgtctcaacgatacctattttctagtgctgagatcctgagacaatgagtggtatgatccaaatgcttcacttcttcgacgttatgagcttttattttacccaggggatggatctgttgaaatgcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaaaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggactgttgggaaagatcctgatggctatccgagatgcaggttttgaaatctcagctatgcagatgttcaatatggatcgggttaatgttgaggaattctatgaagtttataaaggagtagtgaccgaatatcatgacatggtgacagaaatgtattctggcccttgtgtagcaatggagattcaacagaataatgctacaaagacatttcgagaattttgtggacctgctgatcctgaaattgcccggcatttacgccctggaactctcagagcaatctttggtaaaactaagatccagaatgctgttcactgtactgatctgccagaggatggcctattagaggttcaatacttcttcaagatcttggataattagtggtgtggaaagtaaagaagtcacaggttgggacatttagacaagagtgaatcacacacgaggaatgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttcaaacaagtgact

SEQ ID NO: 358351 - DNA, 1721 bp, Homo sapiens
tgccggaaacagaataatggcgtctcgtagccccaggcgacagcgtggaggggcgggtctgtcgattggatgaacgcagctgagattactcccagccactaaggacgaagaggtggggcggtggcgtcccacgcctcgtgcgacagtgggcggggctttgttgcctgagtaaccgtatgatggtggtggtggtggtgtcttcctgtctcaacgatacctattttctagtgctgagatcctgagacaatgaatcatagtgaaagattcgttttcattgcagagtggtatgatccaaatgcttcacttcttcgacgttatgagcttttattttacccaggggatggatctgttgaaatgcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaaaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaaatacagggggtacacatgcagatttgttacgtgggaatattgtgtgatgctgaggtttggagtatggatcccatcatccaggtatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggactgttgggaaagatcctgatggctatccgagatgcaggttttgaaatctcagctatgcagatgttcaatatggatcgggttaatgttgaggaattctatgaagtttataaaggagtagtgaccgaatatcatgacatggtgacagaaatgtattctggcccttgtgtagcaatggagattcaacagaataatgctacaaagacatttcgagaattttgtggacctgctgatcctgaaattgcccggcatttacgccctggaactctcagagcaatctttggtaaaactaagatccagaatgctgttcactgtactgatctgccagaggatggcctattagaggttcaatacttcttcaagatcttggataattagtggtgtggaaagtaaagaagtcacaggttgggacatttagacaagagtgaatcacacacgaggaatgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttcaaacaagtgact

SEQ ID NO: 358352 - DNA, 1198 bp, Homo sapiens
  misc_feature (1191)..(1191): n is a, c, g, or t
  misc_feature (1193)..(1193): n is a, c, g, or t
  misc_feature (1198)..(1198): n is a, c, g, or t
tgccggaaacagaataatggcgtctcgtagccccaggcgacagcgtggaggggcgggtctgtcgattggatgaacgcagctgagattactcccagccactaaggacgaagaggtggggcggtggcgtcccacgcctcgtgcgacagtgggcggggctttgttgcctgagtaaccgtatgatggtggtggtggtggtgtcttcctgtctcaacgatacctattttctagtgctgagatcctgagacaatgaatcatagtgaaagattcgttttcattgcagagtggtatgatccaaatgcttcacttcttcgacgttatgagcttttattttacccaggggatggatctgttgaaatgcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaaaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaattcaccactgatgggcgcctgggttgattccatgtctttgctattttgtatagtgctgcaatgaacagtgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggtatgttgaatacacatatattcagtacattttgttaataggagagcaatgtttattttcttgatgtactttatgtatagaaaaataaagtatacttttaataaaaataacacctggtatgcngnccagn

SEQ ID NO: 358353 - DNA, 1026 bp, Homo sapiens
ccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccaccagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtgaaggagttttttggcttcatagtttctattcatgaggtagtgttacttctttatccccctaaagacaaaatgaagataaagggggattgccaggaatgggtttaaaagcacaaatgtggtagcttatcatctacaccatggagagtgaacccttacgaaatgaaagtcaaatgagaccatccgagaaaaagatgcgcataggcatttgtaccatgatcaaccccacgcacatgaaaactgtgaccaagtgacgtgcctgggagctttgacacacgagccgtgtgaattcactaggaaacatgtaataaagtcatggaagaga

SEQ ID NO: 358354 - DNA, 3412 bp, Homo sapiens
ccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccaccagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtgaaggagttttttggcttcatagtttctattcatgaggtagtgttacttctttatccccctaaagacaaaatgaagataaagggggattgccaggaatgggtttaaaagcacaaatgtggtagcttatcatctacaccatggagagtgaacccttacgaaatgaaagtcaaatgagaccatccgagaaaaagatgcgcataggcatttgtaccatgatcaaccccacgcacatgaaaactgtgaccaagtgacgtgcctgggagctttgacacacgagccgtgtgaattcactaggaaacatgtaataaagtcatggaagagaaaatcgtgtgtaaattttgcctttaactttagaccgcagtatattataatacatttgatatctgaaatatctttacttttttaagagtaagattccatatgtctgtctggaagggagccatggttattcacacgaatatccctgtcacttctccagaggtgtcaggtaactaacacgagcattctttgaagactctgggcacatgaatgatacacagaattgaatgtttaaatttccactttgagtcctcatgaatcatttgagactagtaccagctgatcttgtgtacaggctcagggtcagtgcccaagggctcccgcgtgtgtgttctgatcttcagtgcgtagcacattctccatttagaaaagagtggtcagaataattgtggacggtacagtggctttttaaaactacagtctttaggtgtaaggtttggcgccgggagcaattttatgatcaaatatgatgaactcctaagtcactgaggtgtgattgggccaatgttggcatgaggttcttgctctacttccagtgttttgattccactgggagaatttggcctagtgtgtggctttggatgaatccgtgtagagagaggtgagcttgtcctgttacagatgctgtcagacatagcgatagtaggcacctagggaggaagtggccgttagttttacactgactttttaagaatggagaatgcacgtgggtttctgttgcggatgattcatagtaagcaagcggttgatgctgttaataccggccccacccgattgacattaagtttattcagcttttaaaaagatgaagaactaaggggaacaaatttaagtttgttgcaacttagccacacatgcttccctggtaccagctggaatcagcagctcacaggcatcttcaggacacttcagtgtatatgacacagtactttgttagcgtctgcgtgtgtatggaaagttgacaaaaaatggcatgaaaagatcatgattggattttcttttaaacctgcccttctgtaaaaaatagtttatatatttttaaattagtaggtatgtgtggcttccttttttcctaacattcccagcaaatttttgctgctaagactatcactgttaaagtgaaaattacagggaaaaatgtgatgaatataccgtaactcaaaatgtgatattttcttaaaatcactcttttatgctttaggaactggttggtctccactttgattattagtgtaaagagcctgagtatacgtggatttcattgtaaaatttaactccttgtcttttacttggggcacggggcccctggagggcttccctactttccccactatgttaacaggtaattctgatttatgcctttagtttgacttatttttaacaaaatattagaagttatgctttaaaatgtttaatgtggactgaaattttcatcttttgtttgagaatctatgaagtgtatcatatacgtggcctaaagcaaggtgtgtattttgttattctgaaattgttttgcatctggacaaatactaaatatcccagtggccttttttttttttttttaaacctgtgtatccatctcatccttttgcgcattcctagtaagcaaaaaaatttgttatgccatcttcattattcgaattacagactgaaaaaatatggccagtttttaaagaagtttagattatgttttccatggaaggacaagtctgactgttcataggctgattttctttaagaggattattctgttttacaatttcaattctagatcacattttatatatgctgcatgccaaaaaaaaaaaaaagagaaaactgccttttctggtgtggaggggaagaaaaactaatattctaccttactagtagagttcaaaacaagttttcactgagagccttttcagtaaaagttaaacaagtttgttttttgagcatttgtcagttattctatttcagaagagtcaaaattcaagcacgatacattttgaaggctttgcaaactcctaaacccctgatgagtcctctcattctggaagtgggaatttgagtagatactgatttgtcccgtagtatggcagatgacagggaggtcttttccaatcaggcactcagaacacaggtcaccgtatgttctcagccagtaacaatcatactgaggacgaaggactctccgtttgatgcagacacaattgtaatggagatgtaaaacttcttagcaatcagatggataaattctttgctttttactttaaataggaaattgttttctaaaactaaaatacttgaattgtcagacagtataatctcagcttgtattagtttttgaatgctcccatcgaggaagtgtaacaatccatgaaatgtgaataaatgaaaagtaaacaaaa

SEQ ID NO: 358355 - DNA, 3492 bp, Homo sapiens
ccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccaccagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtgaaggagttttttggcttcatagtttctattcatgaggtagtgttacttctttatccccctaaagacaaaatgaagataaagggggattgccaggaatgggtttaaaagcacaaatgtggtagcttatcatctacaccatggagagtgaacccttacgaaatgaaagtcaaatgagaccatccgagaaaaagatgcgcataggcatttgtaccatgatcaaccccacgcacatgaaaactgtgaccaagtgacgtgcctgggagctttgacacacgagccgtgtgaattcactaggaaacatgtaataaagtcatggaagagaaaatcgtgtgtaaattttgcctttaactttagaccgcagtatattataatacatttgatatctgaaatatctttacttttttaagagtaagattccatatgtctgtctggaagggagccatggttattcacacgaatatccctgtcacttctccagaggtgtcaggtaactaacacgagcattctttgaagactctgggcacatgaatgatacacagaattgaatgtttaaatttccactttgagtcctcatgaatcatttgagactagtaccagctgatcttgtgtacaggctcagggtcagtgcccaagggctcccgcgtgtgtgttctgatcttcagtgcgtagcacattctccatttagaaaagagtggtcagaataattgtggacggtacagtggctttttaaaactacagtctttaggtgtaaggtttggcgccgggagcaattttatgatcaaatatgatgaactcctaagtcactgaggtgtgattgggccaatgttggcatgaggttcttgctctacttccagtgttttgattccactgggagaatttggcctagtgtgtggctttggatgaatccgtgtagagagaggtgagcttgtcctgttacagatgctgtcagacatagcgatagtaggcacctagggaggaagtggccgttagttttacactgactttttaagaatggagaatgcacgtgggtttctgttgcggatgattcatagtaagcaagcggttgatgctgttaataccggccccacccgattgacattaagtttattcagcttttaaaaagatgaagaactaaggggaacaaatttaagtttgttgcaacttagccacacatgcttccctggtaccagctggaatcagcagctcacaggcatcttcaggacacttcagtgtatatgacacagtactttgttagcgtctgcgtgtgtatggaaagttgacaaaaaatggcatgaaaagatcatgattggattttcttttaaacctgcccttctgtaaaaaatagtttatatatttttaaattagtaggtatgtgtggcttccttttttcctaacattcccagcaaatttttgctgctaagactatcactgttaaagtgaaaattacagggaaaaatgtgatgaatataccgtaactcaaaatgtgatattttcttaaaatcactcttttatgctttaggaactggttggtctccactttgattattagtgtaaagagcctgagtatacgtggatttcattgtaaaatttaactccttgtcttttacttggggcacggggcccctggagggcttccctactttccccactatgttaacaggtaattctgatttatgcctttagtttgacttatttttaacaaaatattagaagttatgctttaaaatgtttaatgtggactgaaattttcatcttttgtttgagaatctatgaagtgtatcatatacgtggcctaaagcaaggtgtgtattttgttattctgaaattgttttgcatctggacaaatactaaatatcccagtggccttttttttttttttttaaacctgtgtatccatctcatccttttgcgcattcctagtaagcaaaaaaatttgttatgccatcttcattattcgaattacagactgaaaaaatatggccagtttttaaagaagtttagattatgttttccatggaaggacaagtctgactgttcataggctgattttctttaagaggattattctgttttacaatttcaattctagatcacattttatatatgctgcatgccaaaaaaaaaaaaaagagaaaactgccttttctggtgtggaggggaagaaaaactaatattctaccttactagtagagttcaaaacaagttttcactgagagccttttcagtaaaagttaaacaagtttgttttttgagcatttgtcagttattctatttcagaagagtcaaaattcaagcacgatacattttgaaggctttgcaaactcctaaacccctgatgagtcctctcattctggaagtgggaatttgagtagatactgatttgtcccgtagtatggcagatgacagggaggtcttttccaatcaggcactcagaacacaggtcaccgtatgttctcagccagtaacaatcatactgaggacgaaggactctccgtttgatgcagacacaattgtaatggagatgtaaaacttcttagcaatcagatggataaattctttgctttttactttaaataggaaattgttttctaaaactaaaatacttgaattgtcagacagtataatctcagcttgtattagtttttgaatgctcccatcgaggaagtgtaacaatccatgaaatgtgaataaatgaaaagtaaacaaaatttatccatctgattgctaagaagttttacatctccattacaattgtgtctgcatcaaacggagagtccttcggtcgacg

SEQ ID NO: 358356 - DNA, 3358 bp, Homo sapiens
ccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccaccagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtgaaggagttttttggcttcatagtttctattcatgaggtagtgttacttctttatccccctaaagacaaaatgaagataaagggggattgccaggaatgggtttaaaagcacaaatgtggtagcttatcatctacaccatggagagtgaacccttacgaaatgaaagtcaaatgagaccatccgagaaaaagatgcgcataggcatttgtaccatgatcaaccccacgcacatgaaaactgtgaccaagtgacgtgcctgggagctttgacacacgagccgtgtgaattcactaggaaacatgtaataaagtcatggaagagaaaatcgtgtgtaaattttgcctttaactttagaccgcagtatattataatacatttgatatctgaaatatctttacttttttaagagtaagattccatatgtctgtctggaagggagccatggttattcacacgaatatccctgtcacttctccagaggtgtcaggtaactaacacgagcattctttgaagactctgggcacatgaatgatacacagaattgaatgtttaaatttccactttgagtcctcatgaatcatttgagactagtaccagctgatcttgtgtacaggctcagggtcagtgcccaagggctcccgcgtgtgtgttctgatcttcagtgcgtagcacattctccatttagaaaagagtggtcagaataattgtggacggtacagtggctttttaaaactacagtctttaggtgtaaggtttggcgccgggagcaattttatgatcaaatatgatgaactcctaagtcactgaggtgtgattgggccaatgttggcatgaggttcttgctctacttccagtgttttgattccactgggagaatttggcctagtgtgtggctttggatgaatccgtgtagagagaggtgagcttgtcctgttacagatgctgtcagacatagcgatagtaggcacctagggaggaagtggccgttagttttacactgactttttaagaatggagaatgcacgtgggtttctgttgcggatgattcatagtaagcaagcggttgatgctgttaataccggccccacccgattgacattaagtttattcagcttttaaaaagatgaagaactaaggggaacaaatttaagtttgttgcaacttagccacacatgcttccctggtaccagctggaatcagcagctcacaggcatcttcaggacacttcagtgtatatgacacagtactttgttagcgtctgcgtgtgtatggaaagttgacaaaaaatggcatgaaaagatcatgattggattttcttttaaacctgcccttctgtaaaaaatagtttatatatttttaaattagtaggtatgtgtggcttccttttttcctaacattcccagcaaatttttgctgctaagactatcactgttaaagtgaaaattacagggaaaaatgtgatgaatataccgtaactcaaaatgtgatattttcttaaaatcactcttttatgctttaggaactggttggtctccactttgattattagtgtaaagagcctgagtatacgtggatttcattgttactttccccactatgttaacaggtaattctgatttatgcctttagtttgacttatttttaacaaaatattagaagttatgctttaaaatgtttaatgtggactgaaattttcatcttttgtttgagaatctatgaagtgtatcatatacgtggcctaaagcaaggtgtgtattttgttattctgaaattgttttgcatctggacaaatactaaatatcccagtggccttttttttttttttttaaacctgtgtatccatctcatccttttgcgcattcctagtaagcaaaaaaatttgttatgccatcttcattattcgaattacagactgaaaaaatatggccagtttttaaagaagtttagattatgttttccatggaaggacaagtctgactgttcataggctgattttctttaagaggattattctgttttacaatttcaattctagatcacattttatatatgctgcatgccaaaaaaaaaaaaaagagaaaactgccttttctggtgtggaggggaagaaaaactaatattctaccttactagtagagttcaaaacaagttttcactgagagccttttcagtaaaagttaaacaagtttgttttttgagcatttgtcagttattctatttcagaagagtcaaaattcaagcacgatacattttgaaggctttgcaaactcctaaacccctgatgagtcctctcattctggaagtgggaatttgagtagatactgatttgtcccgtagtatggcagatgacagggaggtcttttccaatcaggcactcagaacacaggtcaccgtatgttctcagccagtaacaatcatactgaggacgaaggactctccgtttgatgcagacacaattgtaatggagatgtaaaacttcttagcaatcagatggataaattctttgctttttactttaaataggaaattgttttctaaaactaaaatacttgaattgtcagacagtataatctcagcttgtattagtttttgaatgctcccatcgaggaagtgtaacaatccatgaaatgtgaataaatgaaaagtaaacaaaa

SEQ ID NO: 358357 - DNA, 3359 bp, Homo sapiens
ccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccaccagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtgaaggagttttttggcttcatagtttctattcatgaggtagtgttacttctttatccccctaaagacaaaatgaagataaagggggattgccaggaatgggtttaaaagcacaaatgtggtagcttatcatctacaccatggagagtgaacccttacgaaatgaaagtcaaatgagaccatccgagaaaaagatgcgcataggcatttgtaccatgatcaaccccacgcacatgaaaactgtgaccaagtgacgtgcctgggagctttgacacacgagccgtgtgaattcactaggaaacatgtaataaagtcatggaagagaaaatcgtgtgtaaattttgcctttaactttagaccgcagtatattataatacatttgatatctgaaatatctttacttttttaagagtaagattccatatgtctgtctggaagggagccatggttattcacacgaatatccctgtcacttctccagaggtgtcaggtaactaacacgagcattctttgaagactctgggcacatgaatgatacacagaattgaatgtttaaatttccactttgagtcctcatgaatcatttgagactagtaccagctgatcttgtgtacaggctcagggtcagtgcccaagggctcccgcgtgtgtgttctgatcttcagtgcgtagcacattctccatttagaaaagagtggtcagaataattgtggacggtacagtggctttttaaaactacagtctttaggtgtaaggtttggcgccgggagcaattttatgatcaaatatgatgaactcctaagtcactgaggtgtgattgggccaatgttggcatgaggttcttgctctacttccagtgttttgattccactgggagaatttggcctagtgtgtggctttggatgaatccgtgtagagagaggtgagcttgtcctgttacagatgctgtcagacatagcgatagtaggcacctagggaggaagtggccgttagttttacactgactttttaagaatggagaatgcacgtgggtttctgttgcggatgattcatagtaagcaagcggttgatgctgttaataccggccccacccgattgacattaagtttattcagcttttaaaaagatgaagaactaaggggaacaaatttaagtttgttgcaacttagccacacatgcttccctggtaccagctggaatcagcagctcacaggcatcttcaggacacttcagtgtatatgacacagtactttgttagcgtctgcgtgtgtatggaaagttgacaaaaaatggcatgaaaagatcatgattggattttcttttaaacctgcccttctgtaaaaaatagtttatatatttttaaattagtaggtatgtgtggcttccttttttcctaacattcccagcaaatttttgctgctaagactatcactgttaaagtgaaaattacagggaaaaatgtgatgaatataccgtaactcaaaatgtgatattttcttaaaatcactcttttatgctttaggaactggttggtctccactttgattattagtgtaaagagcctgagtatacgtggatttcattgtaaaatttaactccttgtcttttacttggggcacggggcccctggagggcttccctactttccccactatgttaacaggtaattctgatttatgcctttagtttgacttatttttaacaaaatattagaagttatgcttttgtatcatatacgtggcctaaagcaaggtgtgtattttgttattctgaaattgttttgcatctggacaaatactaaatatcccagtggccttttttttttttttttaaacctgtgtatccatctcatccttttgcgcattcctagtaagcaaaaaaatttgttatgccatcttcattattcgaattacagactgaaaaaatatggccagtttttaaagaagtttagattatgttttccatggaaggacaagtctgactgttcataggctgattttctttaagaggattattctgttttacaatttcaattctagatcacattttatatatgctgcatgccaaaaaaaaaaaaaagagaaaactgccttttctggtgtggaggggaagaaaaactaatattctaccttactagtagagttcaaaacaagttttcactgagagccttttcagtaaaagttaaacaagtttgttttttgagcatttgtcagttattctatttcagaagagtcaaaattcaagcacgatacattttgaaggctttgcaaactcctaaacccctgatgagtcctctcattctggaagtgggaatttgagtagatactgatttgtcccgtagtatggcagatgacagggaggtcttttccaatcaggcactcagaacacaggtcaccgtatgttctcagccagtaacaatcatactgaggacgaaggactctccgtttgatgcagacacaattgtaatggagatgtaaaacttcttagcaatcagatggataaattctttgctttttactttaaataggaaattgttttctaaaactaaaatacttgaattgtcagacagtataatctcagcttgtattagtttttgaatgctcccatcgaggaagtgtaacaatccatgaaatgtgaataaatgaaaagtaaacaaaa

SEQ ID NO: 358358 - DNA, 1562 bp, Homo sapiens
taaaaatatataaaactatttttacagaagggcaggtttaaaagaaaatccaatcatgatcttttcatgccattttttggtcaactttccatacacacgcagacgctaacaaagtactgtgtcatatacactgaagtgtcctgaagatgcctgtgagctgctgattccagctggtaccagggaagcatgtgtggctaagtggcaacaaacttaaattagtaggtatgtgtggcttccttttttcctaacattcccagcaaatttttgctgctaagactatcactgttaaagtgaaaattacagggaaaaatgtgatgaatataccgtaactcaaaatgtgatattttcttaaaatcactcttttatgctttaggaactggttggtctccactttgattattagtgtaaagagcctgagtatacgtggatttcattgtaaaatttaactccttgtcttttacttggggcacggggcccctggagggcttccctactttccccactatgttaacaggtaattctgatttatgcctttagtttgacttatttttaacaaaatattagaagttatgctttaaaatgtttaatgtggactgaaattttcatcttttgtttgagaatctatgaagtgtatcatatacgtggcctaaagcaaggtgtgtattttgttattctgaaattgttttgcatctggacaaatactaaatatcccagtggccttttttttttttttttaaacctgtgtatccatctcatccttttgcgcattcctagtaagcaaaaaaatttgttatgccatcttcattattcgaattacagactgaaaaaatatggccagtttttaaagaagtttagattatgttttccatggaaggacaagtctgactgttcataggctgattttctttaagaggattattctgttttacaatttcaattctagatcacattttatatatgctgcatgccaaaaaaaaaaaaaagagaaaactgccttttctggtgtggaggggaagaaaaactaatattctaccttactagtagagttcaaaacaagttttcactgagagccttttcagtaaaagttaaacaagtttgttttttgagcatttgtcagttattctatttcagaagagtcaaaattcaagcacgatacattttgaaggctttgcaaactcctaaacccctgatgagtcctctcattctggaagtgggaatttgagtagatactgatttgtcccgtagtatggcagatgacagggaggtcttttccaatcaggcactcagaacacaggtcaccgtatgttctcagccagtaacaatcatactgaggacgaaggactctccgtttgatgcagacacaattgtaatggagatgtaaaacttcttagcaatcagatggataaattctttgctttttactttaaataggaaattgttttctaaaactaaaatacttgaattgtcagacagtataatctcagcttgtattagtttttgaatgctcccatcgaggaagtgtaacaatccatgaaatgtgaataaatgaaaagtaaacaaaa

SEQ ID NO: 358359 - DNA, 3761 bp, Homo sapiens
ccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccaccagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtgaaggagttttttggcttcatagtttctattcatgaggtagtgttacttctttatccccctaaagacaaaatgaagataaagggggattgccaggaatgggtttaaaagcacaaatgtggtagcttatcatctacaccatggagagtgaacccttacgaaatgaaagtcaaatgagaccatccgagaaaaagatgcgcataggcatttgtaccatgatcaaccccacgcacatgaaaactgtgaccaagtgacgtgcctgggagctttgacacacgagccgtgtgaattcactaggaaacatgtaataaagtcatggaagagaaaatcgtgtgtaaattttgcctttaactttagaccgcagtatattataatacatttgatatctgaaatatctttacttttttaagagtaagattccatatgtctgtctggaagggagccatggttattcacacgaatatccctgtcacttctccagaggtgtcaggtaactaacacgagcattctttgaagactctgggcacatgaatgatacacagaattgaatgtttaaatttccactttgagtcctcatgaatcatttgagactagtaccagctgatcttgtgtacaggctcagggtcagtgcccaagggctcccgcgtgtgtgttctgatcttcagtgcgtagcacattctccatttagaaaagagtggtcagaataattgtggacggtacagtggctttttaaaactacagtctttaggtgtaaggtttggcgccgggagcaattttatgatcaaatatgatgaactcctaagtcactgaggtgtgattgggccaatgttggcatgaggttcttgctctacttccagtgttttgattccactgggagaatttggcctagtgtgtggctttggatgaatccgtgtagagagaggtgagcttgtcctgttacagatgctgtcagacatagcgatagtaggcacctagggaggaagtggccgttagttttacactgactttttaagaatggagaatgcacgtgggtttctgttgcggatgattcatagtaagcaagcggttgatgctgttaataccggccccacccgattgacattaagtttattcagcttttaaaaagatgaagaactaaggggaacaaatttaagtttgttgcaacttagccacacatgcttccctggtaccagctggaatcagcagctcacaggcatcttcaggacacttcagtgtatatgacacagtactttgttagcgtctgcgtgtgtatggaaagttgacaaaaaatggcatgaaaagatcatgattggattttcttttaaacctgcccttctgtaaaaaatagtttatatatttttaaattagtaggtatgtgtggcttccttttttcctaacattcccagcaaatttttgctgctaagactatcactgttaaagtgaaaattacagggaaaaatgtgatgaatataccgtaactcaaaatgtgatattttcttaaaatcactcttttatgctttaggaactggttggtctccactttgattattagtgtaaagagcctgagtatacgtggatttcattgtaaaatttaactccttgtcttttacttggggcacggggcccctggagggcttccctactttccccactatgttaacaggtaattctgatttatgcctttagtttgacttatttttaacaaaatattagaagttatgctttaaaatgtttaatgtggactgaaattttcatcttttgtttgagaatctatgaagtgtatcatatacgtggcctaaagcaaggtgtgtattttgttattctgaaattgttttgcatctggacaaatactaaatatcccagtggccttttttttttttttttaaacctgtgtatccatctcatccttttgcgcattcctagtaagcaaaaaaatttgttatgccatcttcattattcgaattacagactgaaaaaatatggccagtttttaaagaagtttagattatgttttccatggaaggacaagtctgactgttcataggctgattttctttaagaggattattctgttttacaatttcaattctagatcacattttatatatgctgcatgccaaaaaaaaaaaaaagagaaaactgccttttctggtgtggaggggaagaaaaactaatattctaccttactagtagagttcaaaacaagttttcactgagagccttttcagtaaaagttaaacaagtttgttttttgagcatttgtcagttattctatttcagaagagtcaaaattcaagcacgatacattttgaaggctttgcaaactcctaaacccctgatgagtcctctcattctggaagtgggaatttgagtagatactgatttgtcccgtagtatggcagatgacagggaggtcttttccaatcaggcactcagaacacaggtcaccgtatgttctcagccagtaacaatcatactgaggacgaaggactctccgtttgatgcagacacaattgtaatggagatgtaaaacttcttagcaatcagatggataaattctttgctttttactttaaataggaaattgttttctaaaactaaaatacttgaattgtcagacagtataatctcagcttgtattagtttttgaatgctcccatcgaggaagtgtaacaatccatgaaatgtgaataaatgaaaagtaaacaaaaaaaaaaaaaaaaaaaaaaaaatgggggtattgggggggcggggaaacaacgcgcggtaatgagaaagggactgggccatagcgtgcttccggaacccagtttgtggttacagggggaaaatcggcgggcccccaagagagagcggaaataaattcgaacacccggttaccgcataaacatgcgcgaaaatgagacacacgcacaccgacaccaaggcgaagagaagaagctaacaacagtgacaccaatcgggtcgaaaagacttaacaaggcgaaaacacagcgacgcaacccgaaagtcatagacaaatgctatacacaacactagacaggcagcaacacacagaag

SEQ ID NO: 358360 - DNA, 2810 bp, Homo sapiens
ggcacgagacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaaaaaaaaaaaaaaaactcgagcaaacatggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgagcaaagggcagaggcagttggcctatgagtgggctgatgcgtgaggttggccacacattccttcctgtggacttgacattttggaagaactctttgccagataatgagttcattttagttttatgctcccattgaaaaattttccactatttttataagctgttaatttcttgagtactttataacatgtctgtagcttggataaaccaagtaagtattttttttttgtctttagcgaagtttagactgtgaatatgatgacacagattcttttttatggtggctttgcttgttttaaatttttgcatgacttttcatctttttatgtgtgtttcctgtagtttgatccgaaggaaaagagtatagtagcctgagaatcaggagatgggagttttagtcgtaggccttatgataattaccccgcggtggtgtgtagaaaagtatgtaaatttgctctgttttaagactttgaactacctcaagaagaggaatctaatacaatatttgtaatgttt

SEQ ID NO: 358361 - DNA, 892 bp, Homo sapiens
atggggttttgccatgttggccaggctggtcttgaactcctgacctcaagtgatctgtccgcctcagcctcccaaagtactgagattacaggcatgagccaccgtgcccagcccatcttcatcttctttacttgaacttaattctttttcatgcatcttcccttctttcctcttttctcctccacccaaatgtcttaactgttaacattcccaggtgtttggtcctgggcctctggaggttgtgaaggagcactgctcagtcctcccttcaagaaagcagcttcaaggagttcaattacaaaagctcctggcattggggacctgccgccatgttcctgcccagggcatgctggtcctggctgtcaccaagcacagtggaggtcaggtgctaggccatttctgcccgacacaggcctcctctaatgagcagtctgaggccaggcacaggaggctgaggcaggagaatcgcttgaacccaggaggtggacgttgcagtgagccgagatcgagccactgcactccagcctgggtgacggagtaagacttcgtctcaaaaaataaaaaataaaaaaatactgagcagtctgcttgggcgcttccatcagcctggccatgacatctttggagctgtcctgccctcttttgccccggtgttccttggcccacctgtcagacctacatcataggctcttcctgtcttctgtttcctctcccctttctctaacataggtgtttctcctgagaaagaaaaaaaccacctgtccctgacattcagaagctgacaacactgttcggtcatgccattctcctgttggacataaacagtctctgaatgccaaccccaaagttgctctcaggccatgataaaataaaccacttaataattttgtct

SEQ ID NO: 358362 - DNA, 5545 bp, Homo sapiens
ggcacgagacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaaaaaaaaaaaaaaaactcgagcaaacatggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgagcaaagggcagaggcagttggcctatgagtgggctgatgcgtgaggttggccacacattccttcctgtggacttgacattttggaagaactctttgccagataatgagttcattttagttttatgctcccattgaaaaattttccactatttttataagctgttaatttcttgagtactttataacatgtctgtagcttggataaaccaagtaagtattttttttttgtctttagcgaagtttagactgtgaatatgatgacacagattcttttttatggtggctttgcttgttttaaatttttgcatgacttttcatctttttatgtgtgtttcctgtagtttgatccgaaggaaaagagtatagtagcctgagaatcaggagatgggagttttagtcgtaggccttatgataattaccccgcggtggtgtgtagaaaagtatgtaaatttgctctgttttaagactttgaactacctcaagaagaggaatctaatacaatatttgtaatgtttccagagctctcagaatgaggatttttttgtaaataggtcagaagacgatggaactgtcctgggttagtatagtaatcttacagtaggatccttaggttgatgctgacttctgtttggggtatgtttatattttatgtggtgtttactttttttttttgacatagaaggatatagtgggagcagtgatacgctaacattcattacattctgcagtaatgaatctgtttaatgggtcagacactgttttcagtagcatgacagtggggtcataggtgagctgtgaggggctaaatcttgctctgattgtctctttctgttttgagttttgtttgcgtgtatcatttttgttctacattttgggaggggaaacattttccgttaaggaaggttgttgccagtggatttgactccaagggactagagtgtcgtggtgggggtggggaggggctgcagggtgatcattggctactgagcctccacaaagagcatgtggtgccctgcctttgggagggtattttgctctcgttagttttgtgggcagcctcagattccctgttgagttgctgttaagaaatggagatttctggctctcattgggtaaggttttctgagttttatatcttattagatcacatccctttacccagaacaaatgcttcactgtcttctgattggcagtactcctgtggctttgtgccttgactcattttgttgtcttcagccttgaaggccccttcccacatggactgacatccactcatgtgcctgatccctgaagcctcccagcacccattcagttgcatccccagggcacaggactttgatctcttctgttgccctcgctaggttctccctggtgggttagtgctttgtatctgtctctctgcccctcactaattctacacccatgagaattagacattattctccttaaatatataaggaccatataatctgtatctttttggtgtgtgtatatggtatctggcacatggatctctgattaccagcctgacatcaacaaatcccctcagttacaacgtataggttaaacaaagcttttaaaagctcatgtggtatgacctcaaggttgctaacctggtcactcatggtaattagaaactctgattggcagctttgtatttcttgactaaaaacctaaataaactgattaggttttaggcgttctttcaaagaggttcttgagaagattgagaactatcctatttggtgcttagtgaaaagattttgaattactgtacgtaccagttgttgccatttctttattaaattcagaagtttttttgccaaaaaaaaatttttcaatcttctctgtttgtagacatcttactgggtgatgaataatcctctaagaaaccctctgagctgctaactctttcagggagaaaatcacaagccatcttctcaagttcccctagaaacctgtggaatgccctctgccaagcactgctctggtactggggagtggagtattatgtcttggaagagactcctgctgtgattgtccaggggtacgttctggtctggcttggtgcttgaccttaggtctgcccacaggcttcaggctttcaactttgaaacaaacatctgtgccacacacattttgtaaatgatcccattcagtcttctagaagccttataacagaatcaatattgtttttcccattttcacagatggataataaatctgtaaaatagggataagactaggacctattccccaggattacttctgcagattaaaggagatgttgaggccaggtgcagtggctcacgcctgtaatcccagcactttggggggctgaggcaggagaatcgcttgaacctgggaggcagaggttgtgatgagccaagatcgtgccattgcactccatcctgggctacaagagtgaaactccgtctcaaaaaagaaaaaggagatgttgaatgggaagtcagcaagggtgctagaatgtagcaagtattcttcaggtgttagtgatttctgttgttcgggaagaggagggttatggaggaagagtatgggatttaggtgggttaagtgatttgcccaaagtcaagaggttagtctttaacctttggcagaagcaggatttgaagtgagttttcacacccctcttccctggtcagtgtgttgataacagcccacccacctgtggttccagggtgttcttaagaagccaaggttgtcttgggtgtggtagctctttgaaaggtagaaagttccaccaagaaggccttttttcttgaatactgcttagcttccttgtcaggctccaagatgcagattgcctgtgggctatctctctccacagataaacctactcacatcttcaggacagccttttttttttgagacagaagacttcgtctcaaaaaataaaaaataaaaaaatactgagcagtctgcttgggcgcttccatcagcctggccatgacatctttggagctgtcctgccctcttttgccccggtgttccttggcccacctgtcagacctacatcataggctcttcctgtcttctgtttcctctcccctttctctaacataggtgtttctcctgagaaagaaaaaaaccacctgtccctgacattcagaagctgacaacactgttcggtcatgccattctcctgttggacataaacagtctctgaatgccaaccccaaagttgctctcaggccatgataaaataaaccacttaataattttgtct

SEQ ID NO: 358363 - DNA, 4122 bp, Homo sapiens
ggcacgagacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaaaaaaaaaaaaaaaactcgagcaaacatggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgagcaaagggcagaggcagttggcctatgagtgggctgatgcgtgaggttggccacacattccttcctgtggacttgacattttggaagaactctttgccagataatgagttcattttagttttatgctcccattgaaaaattttccactatttttataagctgttaatttcttgagtactttataacatgtctgtagcttggataaaccaagtaagtattttttttttgtctttagcgaagtttagactgtgaatatgatgacacagattcttttttatggtggctttgcttgttttaaatttttgcatgacttttcatctttttatgtgtgtttcctgtagtttgatccgaaggaaaagagtatagtagcctgagaatcaggagatgggagttttagtcgtaggccttatgataattaccccgcggtggtgtgtagaaaagtatgtaaatttgctctgttttaagactttgaactacctcaagaagaggaatctaatacaatatttgtaatgtttccagagctctcagaatgaggatttttttgtaaataggtcagaagacgatggaactgtcctgggttagtatagtaatcttacagtaggatccttaggttgatgctgacttctgtttggggtatgtttatattttatgtggtgtttactttttttttttgacatagaaggatatagtgggagcagtgatacgctaacattcattacattctgcagtaatgaatctgtttaatgggtcagacactgttttcagtagcatgacagtggggtcataggtgagctgtgaggggctaaatcttgctctgattgtctctttctgttttgagttttgtttgcgtgtatcatttttgttctacattttgggaggggaaacattttccgttaaggaaggttgttgccagtggatttgactccaagggactagagtgtcgtggtgggggtggggaggggctgcagggtgatcattggctactgagcctccacaaagagcatgtggtgccctgcctttgggagggtattttgctctcgttagttttgtgggcagcctcagattccctgttgagttgctgttaagaaatggagatttctggctctcattgggtaaggttttctgagttttatatcttattagatcacatccctttacccagaacaaatgcttcactgtcttctgattggcagtactcctgtggctttgtgccttgactcattttgttgtcttcagccttgaaggccccttcccacatggactgacatccactcatgtgcctgatccctgaagcctcccagcacccattcagttgcatccccagggcacaggactttgatctcttctgttgccctcgctaggttctccctggtgggttagtgctttgtatctgtctctctgcccctcactaattctacacccatgagaattagacattattctccttaaatatataaggaccatataatctgtatctttttggtgtgtgtatatggtatctggcacatggatctctgattaccagcctgacatcaacaaatcccctcagttacaacgtataggttaaacaaagcttttaaaagctcatgtggtatgacctcaaggttgctaacctggtcactcatggtaattagaaactctgattggcagctttgtatttcttgactaaaaacctaaataaactgattaggttttaggcgttctttcaaagaggttcttgagaagattgagaactatcctatttggtgcttagtgaaaagattttgaattactgtacgtaccagttgttgccatttctttattaaattcagaagtttttttgccaaa

SEQ ID NO: 358364 - DNA, 4184 bp, Homo sapiens
ggcacgagacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaaaaaaaaaaaaaaaactcgagcaaacatggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgagcaaagggcagaggcagttggcctatgagtgggctgatgcgtgaggttggccacacattccttcctgtggacttgacattttggaagaactctttgccagataatgagttcattttagttttatgctcccattgaaaaattttccactatttttataagctgttaatttcttgagtactttataacatgtctgtagcttggataaaccaagtaagtattttttttttgtctttagcgaagtttagactgtgaatatgatgacacagattcttttttatggtggctttgcttgttttaaatttttgcatgacttttcatctttttatgtgtgtttcctgtagtttgatccgaaggaaaagagtatagtagcctgagaatcaggagatgggagttttagtcgtaggccttatgataattaccccgcggtggtgtgtagaaaagtatgtaaatttgctctgttttaagactttgaactacctcaagaagaggaatctaatacaatatttgtaatgtttccagagctctcagaatgaggatttttttgtaaataggtcagaagacgatggaactgtcctgggttagtatagtaatcttacagtaggatccttaggttgatgctgacttctgtttggggtatgtttatattttatgtggtgtttactttttttttttgacatagaaggatatagtgggagcagtgatacgctaacattcattacattctgcagtaatgaatctgtttaatgggtcagacactgttttcagtagcatgacagtggggtcataggtgagctgtgaggggctaaatcttgctctgattgtctctttctgttttgagttttgtttgcgtgtatcatttttgttctacattttgggaggggaaacattttccgttaaggaaggttgttgccagtggatttgactccaagggactagagtgtcgtggtgggggtggggaggggctgcagggtgatcattggctactgagcctccacaaagagcatgtggtgccctgcctttgggagggtattttgctctcgttagttttgtgggcagcctcagattccctgttgagttgctgttaagaaatggagatttctggctctcattgggtaaggttttctgagttttatatcttattagatcacatccctttacccagaacaaatgcttcactgtcttctgattggcagtactcctgtggctttgtgccttgactcattttgttgtcttcagccttgaaggccccttcccacatggactgacatccactcatgtgcctgatccctgaagcctcccagcacccattcagttgcatccccagggcacaggactttgatctcttctgttgccctcgctaggttctccctggtgggttagtgctttgtatctgtctctctgcccctcactaattctacacccatgagaattagacattattctccttaaatatataaggaccatataatctgtatctttttggtgtgtgtatatggtatctggcacatggatctctgattaccagcctgacatcaacaaatcccctcagttacaacgtataggttaaacaaagcttttaaaagctcatgtggtatgacctcaaggttgctaacctggtcactcatggtaattagaaactctgattggcagctttgtatttcttggtggagtcagtggtaataaccccttatcatttctgattgtgtttgtttgattcttctctgttttcttattagtctagctagtggtctattttttttaattttttaaaaaaaccagctcctggatttgttgaattttttgaagggtttttcgtgtctctctctcttttagttcagctctgatattggttatttcttgtcttctgctagcttgggagtttgttggct

SEQ ID NO: 358365 - DNA, 2644 bp, Homo sapiens
ggcacgagacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaaaaaaaaaaaaaaaactcgagcaaacatggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacacatcttactgggtgatgaataatcctctaagaaaccctctgagctgctaactctttcagggagaaaatcacaagccatcttctcaagttcccctagaaacctgtggaatgccctctgccaagcactgctctggtactggggagtggagtattatgtcttggaagagactcctgctgtgattgtccaggggtgtttctcctgagaaagaaaaaaaccacctgtccctgacattcagaagctgacaacactgttcggtcatgccattctcctgttggacataaacagtctctgaatgccaaccccaaagttgctctcaggccatgataaaataaaccacttaataattttgtct

SEQ ID NO: 358366 - DNA, 2143 bp, Homo sapiens
  misc_feature (2101)..(2101): n is a, c, g, or t
  misc_feature (2114)..(2114): n is a, c, g, or t
  misc_feature (2121)..(2121): n is a, c, g, or t
  misc_feature (2127)..(2127): n is a, c, g, or t
  misc_feature (2134)..(2134): n is a, c, g, or t
ggcacgagacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaaaaaaaaaaaaaaaactcgagcaaacatggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtaagcattccctctgtgtacacaatgttctgggcttcagcagtatttcctagttgctaattttatacttcatgtgtttcagtcctgcttttatcctaagaccatttcagggacctnatggggggtttgnggggggntctttnggggggnccccccccc

SEQ ID NO: 358367 - DNA, 626 bp, Homo sapiens
aattcaagaccagcctggccaacatggcgaaacaccatctctactaaaaatacgaaaattaaggctgggcgcggtggctcatgcctgtaatcccagccctttgggaggcagaggcaggcggatcacgaggtcagattgagaccatcctgaccaacatggtgaaaccccgtctctactaaaaatacaaaattatctgggtgtagtggtgtgcacctgacagctactcgggaggctgacgtaggaaaattacttgaacccgggaggcagaggttgaagacttcgtctcaaaaaataaaaaataaaaaaatactgagcagtctgcttgggcgcttccatcagcctggccatgacatctttggagctgtcctgccctcttttgccccggtgttccttggcccacctgtcagacctacatcataggctcttcctgtcttctgtttcctctcccctttctctaacataggtgtttctcctgagaaagaaaaaaaccacctgtccctgacattcagaagctgacaacactgttcggtcatgccattctcctgttggacataaacagtctctgaatgccaaccccaaagttgctctcaggccatgataaaataaaccacttaataattttgtct

SEQ ID NO: 358368 - DNA, 3162 bp, Homo sapiens
ggcacgagacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaaaaaaaaaaaaaaaactcgagcaaacatggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgagcaaagggcagaggcagttggcctatgagtgggctgatgcgtgaggttggccacacattccttcctgtggacttgacattttggaagaactctttgccagataatgagttcattttagttttatgctcccattgaaaaattttccactatttttataagctgttaatttcttgagtactttataacatgtctgtagcttggataaaccaagtaagtattttttttttgtctttagcgaagtttagactgtgaatatgatgacacagattcttttttatggtggctttgcttgttttaaatttttgcatgacttttcatctttttatgtgtgtttcctgtagtttgatccgaaggaaaagagtatagtagcctgagaatcaggagatgggagttttagtcgtaggccttatgataattaccccgcggtggtgtgtagaaaagtatgtaaatttgctctgttttaagactttgaactacctcaagaagaggaatctaatacaatatttgtaatgtttaaaaaaaaaaaaaaaaaaaaaaaaaaaaaaaaaaaaaaaaaaaaaaaaaaaaaaaacaaaaaaaaaaaaaaaaaaaaaaaaaaaagttgggggggggggagcggccccgagagaaaaacgtttaaaaacacacttgtgtggggcggggggccccaaagaaagagagaagaaaacacgggcgcaagagggtcaacagaaaggaaacgggggaaaaaaagggggggggggcatcacacacacaaaaaaaagcgggggggtgagagaggggttggcgagcacacgcgagggggctctgggagacaagggaggggatacaagaggggcgcacgagagcggagataagttcccgggg

SEQ ID NO: 358369 - DNA, 4712 bp, Homo sapiens
ggcacgagacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaaaaaaaaaaaaaaaactcgagcaaacatggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgagcaaagggcagaggcagttggcctatgagtgggctgatgcgtgaggttggccacacattccttcctgtggacttgacattttggaagaactctttgccagataatgagttcattttagttttatgctcccattgaaaaattttccactatttttataagctgttaatttcttgagtactttataacatgtctgtagcttggataaaccaagtaagtattttttttttgtctttagcgaagtttagactgtgaatatgatgacacagattcttttttatggtggctttgcttgttttaaatttttgcatgacttttcatctttttatgtgtgtttcctgtagtttgatccgaaggaaaagagtatagtagcctgagaatcaggagatgggagttttagtcgtaggccttatgataattaccccgcggtggtgtgtagaaaagtatgtaaatttgctctgttttaagactttgaactacctcaagaagaggaatctaatacaatatttgtaatgtttccagagctctcagaatgaggatttttttgtaaataggtcagaagacgatggaactgtcctgggttagtatagtaatcttacagtaggatccttaggttgatgctgacttctgtttggggtatgtttatattttatgtggtgtttactttttttttttgacatagaaggatatagtgggagcagtgatacgctaacattcattacattctgcagtaatgaatctgtttaatgggtcagacactgttttcagtagcatgacagtggggtcataggtgagctgtgaggggctaaatcttgctctgattgtctctttctgttttgagttttgtttgcgtgtatcatttttgttctacattttgggaggggaaacattttccgttaaggaaggttgttgccagtggatttgactccaagggactagagtgtcgtggtgggggtggggaggggctgcagggtgatcattggctactgagcctccacaaagagcatgtggtgccctgcctttgggagggtattttgctctcgttagttttgtgggcagcctcagattccctgttgagttgctgttaagaaatggagatttctggctctcattgggtaaggttttctgagttttatatcttattagatcacatccctttacccagaacaaatgcttcactgtcttctgattggcagtactcctgtggctttgtgccttgactcattttgttgtcttcagccttgaaggccccttcccacatggactgacatccactcatgtgcctgatccctgaagcctcccagcacccattcagttgcatccccagggcacaggactttgatctcttctgttgccctcgctaggttctccctggtgggttagtgctttgtatctgtctctctgcccctcactaattctacacccatgagaattagacattattctccttaaatatataaggaccatataatctgtatctttttggtgtgtgtatatggtatctggcacatggatctctgattaccagcctgacatcaacaaatcccctcagttacaacgtataggttaaacaaagcttttaaaagctcatgtggtatgacctcaaggttgctaacctggtcactcatggtaattagaaactctgattggcagctttgtatttcttgactaaaaacctaaataaactgattaggttttaggcgttctttcaaagaggttcttgagaagattgagaactatcctatttggtgcttagtgaaaagattttgaattactgtacgtaccagttgttgccatttctttattaaattcagaagtttttttgccaaaaaaaaatttttcaatcttctctgtttgtagacatcttactgggtgatgaataatcctctaagaaaccctctgagctgctaactctttcagggagaaaatcacaagccatcttctcaagttcccctagaaacctgtggaatgccctctgccaagcactgctctggtactggggagtggagtattatgtcttggaagagactcctgctgtgattgtccaggggtacgttctggtctggcttggtgcttgaccttaggtctgcccacaggcttcaggctttcaactttgaaacaaacatctgtgccacacacattttgtaaatgatcccattcagtcttctagaagccttataacagaatcaatattgtttttcccattttcacagatggataataaatctgtaaaatagggataagactaggacctattccccaggattaaggcgtgagctgctgtgcctggcagaacagtatgaagtgttaacgccaaaatttgttttagctatcatatataaatcataagcatattatttggttggttggtgttagttcattccttcaatcggatgatttaaaataaatgtttttcaagt

SEQ ID NO: 358370 - DNA, 2515 bp, Homo sapiens
ggcacgagacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaaaaaaaaaaaaaaaactcgagcaaacatggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgagcaaagggcagaggcagttggcctatgagtgggctgatgcgtgaggttggccacacattccttcctgtggacttgacattttggaagaactctttgccagataatgagttcattttagttttatgctcccattgaaaaattttccactatttttataagctgttaatttcttgagtactttataacatgtctgtagcttggataaaccaagtaagtattt

SEQ ID NO: 358371 - DNA, 446 bp, Homo sapiens
cggccgctgcagagcaccgagctgtgtccgggcgggggagcccgcgttgtggcagtggcggcgctcctaggccgcctggtgtggtgcgaggagcggcaggcccgggccgagggcccgtcagggtcgccagcagccgctttcagccactgtgtgtgcgtccggactctggagcccagcggggaatgggtttttgtttttccttcattgttgagaatttaaggacctttgatactgctgcacaatagagattgagttctgggatcagttataatatatattttttttagaaagagaaaatgagctgagagtttacagtagaaaatgcagtgcaaaaattttaaatgaggaatattccatttacaattaatttaaaacttatgaagctgttttaactggcccatctaaatgtgttaattaacatcaatgatggtttcttcctcgtgccg

SEQ ID NO: 358372 - DNA, 4072 bp, Homo sapiens
cacgtagcattgctgcggagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacaatcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccgtctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctaattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaa

SEQ ID NO: 358373 - DNA, 4099 bp, Homo sapiens
cacgtagcattgctgcggagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacaatcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccgtctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctaattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaatttta

SEQ ID NO: 358374 - DNA, 3760 bp, Homo sapiens
gtgagaaggccggggaggcaggccctgctgtcttcctgcaggccggcagcctgctggcagtggaggaccaggccgtccaggaaaggaaggggtcaggaggtcgggcagggcctcagcaggttcagacaagcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccgtctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctaattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaa

SEQ ID NO: 358375 - DNA, 3545 bp, Homo sapiens
caaatccatttccacgtccagggtaaataagcagcaccaggatcatggggctcttccactcctggtgattgaattccgtgggattgattggagggattacaatcatgtagcctgtagcagagacctcagtcactgtgcagagagatctggaagcctcattctggaaacgagtgggacttgatttgggattttggggaaaatgacggccttttttccctcctctttttgtaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccgtctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctaattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaa

SEQ ID NO: 358376 - DNA, 4049 bp, Homo sapiens
gacgctttcttgttgttgcggaataattccatccaaaaccggcagctgttagccgagcaacttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacaatcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacactccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccgtctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctaattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaa

SEQ ID NO: 358377 - DNA, 3861 bp, Homo sapiens
gacgctttcttgttgttgcggaataattccatccaaaaccggcagctgttagccgagcaacttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacaatcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccgtctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaa

SEQ ID NO: 358378 - DNA, 1028 bp, Homo sapiens
ataggaatagtttaattttggtcataaaaaagtcaacaaagtggttgggcataggtggctctatgccctgttatccccagcactttggggaggccaaagaggaaagattgcttgcctcccggagttcgagaccaacctgggcaaaacaatggaaccccggctctaccaaaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaa

SEQ ID NO: 358379 - DNA, 779 bp, Homo sapiens
gagtatctgtgtgcaggtgtgtgcgtgtgtgtgctgtgcgtttgtgtgtgtcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaa

SEQ ID NO: 358380 - DNA, 649 bp, Homo sapiens
gatcttctgtgcagtgtcagtggattgatacagttgacttgtatattcatcaggttgttttgcagcaggtggaagaacagccgtactgtttcttcctttccaaaggccacagggagaccttgtaatctgctttccagagcctttgggaaagtggtcaacacgctgccttcttaggaagagcccagagaaacagagggctatcccgggggttttgtttatctgcccttgtggagttggcagacgtgggcttctgtcttccctgctatggcctcagagctttagatcctgctggtttagggaatttgaatctttcctgttagggaaaaatgagtgcttactgtgctttgtagaaatattttcagaattcattttctttaaattattttcattgtctttaaattatatctaaacaagtataccatagctttcctgagagggaaaacaatctatccaacacattgtgcactgtcttgctagggttttacagaggaccagttagttctggtggagcagaacacactgatggtggaagagcgggaacgagagattcgccagattgtacagtccatttctgacctgaatgaaatattcagggacttaggggcgatgattgtagaacaggtacgtgagctggccttcctcgtgaata

SEQ ID NO: 358381 - DNA, 3981 bp, Homo sapiens
cacgtagcattgctgcggagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacaatcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccgtctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctaattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttc

SEQ ID NO: 358382 - DNA, 4103 bp, Homo sapiens
gacgctttcttgttgttgcggaataattccatccaaaaccggcagctgttagccgagcaacttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacaatcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccgtctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctaattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaa

SEQ ID NO: 358383 - DNA, 3909 bp, Homo sapiens
cacgtagcattgctgcggagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcaggcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccgtctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctaattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaa

SEQ ID NO: 358384 - DNA, 3138 bp, Homo sapiens
gacgctttcttgttgttgcggaataattccatccaaaaccggcagctgttagccgagcaacttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacaatcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccgtctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctaattagaaactgttttaaggaggggctgggctcggtggctcacgcctgtaatcccagactttgagaggccaaggctggtctcaaactcccgatctcaggtgatccccctgcctcagcctcccaaagtgctgggattacaggcgtgagccaccgtgccctgccaatatttgtctttttagtagagatgg

SEQ ID NO: 358385 - DNA, 347 bp, Homo sapiens
acaaagtatgatctgctttagaagtcctgcttctggctgcctcccaatcttttgtttgtatgtttcaatcaagacatctgctgtctagtgttatttcagataataatcttaatattaagaaatgattcagaatatccagccataccaaagcaaaaaggcagcatacaatctcttaagagaagacataattaagttaaggaaaacagagagttgccattttttaagagtgaatatgcatgtccaaattacttcaattagcataaccacatctttccagaacagttggctaatatcatggccttcctcattaggattcaacttcacaattgtgaataacaactacaaag

SEQ ID NO: 358386 - DNA, 2007 bp, Homo sapiens
ggacccagaggcggggcgtcggcccggggaccactgctcctccggggcgtggctgcaggaggctggaggagccccgcgggacccagaggcggggcgtcggccggggaccgctgctcctccggggcgtggctgctgccgagcatctcccagctcagccgagcccgtgcccaggccacgctttgttccagccgccgcctcctctaccctacggcgtccggagccatccctcgcctgctcgctctctcctttcgcccactccctgcatctgggcctgcatcacctttgccaaccgctcccccgatcctgccgacactcctcccccaaacttctgaccggcacccttgcctggtacccttctctccattcctccccctccatcttctttccccgacccctctcgggtccctcttttcccaaaacccgggtctctccgcgtggccccgcctccaggccggggatgtcccccgcggccccgcgcccatggtcctgacgctgcttctctccgcctacaagctgtgtcgcttcttcgccatgtcgggcccacggccgggcgccgagcggctggcggtgcctgggccagatgggggcggtggcacgggcccatggtgggctgcgggtggcccgggcccgcgaaagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctgcggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccggtgagcgcgccaggccggggttgggagagcgccgcgtggtgtggacagttaagcgcctgcgttcccgtgtgccttgcgccgtgcctttgcctccctcacctctctgactgcctgcactacatctctgttaggggtcagcctgtctgtttcacagataaggaaactgagccttgggaaagtttagtgacttgctcagtggatcacagtgaactaagatttgctcccagggctagtggggtgaggaatggagttacaggacaggagtccgtccctggctctatggatggagatggcatcctattgccaattctccctctcccccgccccccaagcccacagctctccttcccaccggcttgggttcccgtctatgacaccttctctcgccatcatcccatccctctcccaatgagagaagaagggaaacacaacgctcagaaaagagggagggagacctctcctttccctcctccccaggctgtaaggcgtgctggcctgaggctgcttactcccttcttgccgccccaatccaacttctgctccatccttcattctggttcttgcaacaggccagacatgatctcattctgcagctgctgatgggaaacagttttctgctgggaggcatgggtgggggaagaggacaccggggtgcagagcccggcggggaccaggcagagtgtgtgttctctcccttcaccccacttagcaccaagatgccgcaagagggtcaaacagaggcctggttgccactcttgcatgtctcttgggatctctcctggagtatgaagacctccaaggactcactttccctcccttctgatgccagagcagaccaagctgtcacactccagtctcatgctgaagtctccagcttctcaagcttagaagagtttttggaagagtcactttcagctcatgcagctctcacaagtgtgaagggagtgggttgggggtgttttccttgccattttcgaaaagaaaaaaattacctggtgattggtggaaagatacaactgtcaaaaatgcatgaatgaagcaatttaggttgggagacca

SEQ ID NO: 358387 - DNA, 651 bp, Homo sapiens
tgaataatagtaataaataatattattaatctcaaaatcctgggctcaagtgatcctcctgcctcagcctcccaaagtgttgggattacaggcgtgacccaccatgcccagctgaattatttaatttcacagttataaaggacacagctcaagaatagccaaatggaagagatacataggatctctacgtatggagggtggaggtgtggatgccatgccttctaccaccttcccagcacctacacctgtttatcaacctggaggctcttcaaaaccccttgtttgggggtttttatggaggttccattatgtaggcatgattgattaaatcattggccattggtgattgaactcaatctccagcacctctctggaggctgggaggtggggctgaaagttccaatcctctagtcatgccctggtctccctggtgaccagccctcttcctgaaactatctaggctacccccatagcaccccccgggcccccagtggggaatcatctctttagcatacaaagacactcatcactcaatgatgggcacaatgttcttgccgcagcttaaagcagtcacaatctcctggagaaagaaaggaaaggaggaagatacccctgtacccatctagggacccttgtagccaggcaggtgct

SEQ ID NO: 358388 - DNA, 5919 bp, Homo sapiens
tgaataatagtaataaataatattattaatctcaaaatcctgggctcaagtgatcctcctgcctcagcctcccaaagtgttgggattacaggcgtgacccaccatgcccagctgaattatttaatttcacagttataaaggacacagctcaagaatagccaaatggaagagatacataggatctctacgtatggagggtggaggtgtggatgccatgccttctaccaccttcccagcacctacacctgtttatcaacctggaggctcttcaaaaccccttgtttgggggtttttatggaggttccattatgtaggcatgattgattaaatcattggccattggtgattgaactcaatctccagcacctctctggaggctgggaggtggggctgaaagttccaatcctctagtcatgccctggtctccctggtgaccagccctcttcctgaaactatctaggctacccccatagcaccccccgggcccccagtggggaatcatctctttagcatacaaagacactcatcactcaagagattccaagggttttagcagctctgtgccaggaactctgggcaaaggaaaaatatttattttttattacactacaagggttaaggtagacatcaaggtggacatcaggactggtgtcctgccctgggcccagcctcgggccagtgggcctcccagcacctgcctggctacaagggtccctagatgggtacaggggtatcttcctcctttcctttctttctccaggagattgtgactgctttaagctgcggcaagaacattgtgcccatcattgatggcttcgagtggcctgagccccaggtcctgcctgaggacatgcaggctgtgcttactttcaacggtatcaagtgagccccagggccctgggaccaggggggtagggtacaaatcaccatgacaggcagagtgtgggcaaacagctgactagcagctccctctgcccagctgtctgaaccacattggctcctgtgcccacaggtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgaaggaaggcagcctcagacaggaattaaggcaatgcccaggcgggcctgggcactgtattctgagcaagggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggctgcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctccaggggatgatttctggctctttgtctccaatcagtcccactccctcctgaggtccccaagggcagtattcagagaggtttcctgcattttatttctatttggtataccctccactgttgtccactgccctgtgtggccttctggttgacctctgcccgatcttctgtctctctgagggaatcagagtccagcatccagccccagctggaacagctgaagtcacaagcctcctctaagccaaggccagtgtgttcagaggtgactgccacccatactaggacaaacacagctcagatcaccaggtcaagcacctaggcctggcttctcctgagacagaggactcagaagtggcctttcctccaaagcctgctcagacacaggtctgtagggccagggtgttctgcttggctgggctgcagctgctacccctcggttggggctgagtcagccagatcctccccctacttctccccaagggccaagaactgctcagggacattaaaggtcaaaagtccagccacactcattcatcctttccccaggcccatgaagagaggcatctcattgtagaatgtatgaggaagtgggaagtatctcagagaatcagctaagtttcctaacttgtccatccaaatgtgatcaccacgattcaacaatttggggcattgctgatctagccgttcctagtggggcttgctcaaggttgcacagcgagtcagtagaagccctggctggccccacttggtaccaatccaccaggcagctcagggctcctgcccagcccagcagcttctgttgtctaacgtatggcaggcagactgggagcaggaaaacagagggccccaaagcccaaggcaccagaaggtttgtttcagtttgctgaagctgatttgtaatgattggcactcttcagccaggggagtgggtaggccatagccaaggatcgattccccaaccacagcaaaggcaacactcttcctccagagatcaccaagcccctcttacctccctccctccttcccaaggctggcactaaccaggtaccacattcattgttaaggaatggctgatgactgctacacgtgttgggaacctggttggggctgtgcagtttgggctggaaggagagatgccagccctcgtgctgcctctggtccctgaagtgtcacctctctcaggacctctcctctggcctgtggggttataagtgatggatagcagaaagggagaactgactcctgtcccaaatagctcctctgccacctgtcctgcagtgggcctgtgtgggttatgattctagatcctagacagaggctgggtcagctgtggatggggtggtgccttggtctctcttgactacctcgtccaaagagagcactgcccttagacaagagttgcttgtcctgctgtgggctgggcttccagctgcagacctccagttgcttggtgttcactttgctcctcttgccctctgtcttctggtccaggcagatcaggggctctggggaaactgctggaactcgaggtgaggatcagccttttccagcatcctgtgagagaccagagagagagtttggatttcatgtggggaaccctcaaggcctgtctggagaagtgacacaggatttactggggtgggctggtccaggtagctctcctgaacctcctccttccccaagctgagaagctgagagctggaggacaatatccagggacatggctctggaaaataactttttttttttaagagacagggtcttgctctgttgtccaggctggagggcagtgacataatcatagctcactgtacccttgaactcctgggctcaagtgatcctcctgcctcagcctccttagtagctgggactaccagtgcataccaccatgcctgggtgattttttaaattttttatacagacaaggtcttgctatgttgcccaggctgatcttgaattcccgggctcaagtggtcctcctgcctcagcctcccacaggatcgggattacaggcaagagcctccacgcccggccatgaaatataattcttaatatcatacaggaaaaagtcagcgggtcaagctagcctgtggcccagccacaactagctgacaaagcttcctggccttccctttaacacagttctgctgccatagttccatctataaaatgggaatggagggaaataggggaactgggagagagaacacagccttgccaagcagcaatgttagcctgatccttcctccacctagctcgccatctcgcccttggaaaatggctcctggaggattaggcagccatctgcaaggagaggggcaacctgggacaagacacccagagggtaaggattccaggaatgaagctgccatttctggttgggaggagaagaggaaacttttaagagaaagggctccattatgagcatgggttcagggccctgcattacccaatcagaacagccgggatgagcaggaggccagctcccaggaggaaggggaaccccttcataaagttcagagtggctgggtagagtgagttgaagatgccggaggccgtcagcatggccaggctattcacacaggccacagcagaaaagagagcacctgtgaagaaataaataccatactctggagtccgaaagggccatattccaactctggcaccaccacctcacagctgtgtgaccgggagtagtcacttaacctatgtctccccttcctcaccagtaaatcctgctacatcatgtactgtgacaaggattcagtaaggtcatatgtggacagtagctggcacagaggggctactaaacaaatggctgctattaaatccacattaaaagtacatgtgatctgacagaacccagcacataaaagaaaaaaaaaagtacatgtgatattgtct

SEQ ID NO: 358389 - DNA, 5390 bp, Homo sapiens
tggggacaaggctgtggcactgacacaggacttacttgcagtctcctgaaggtgcacctgcagctgcatggcttcagtgtcttcattgatgtggagaagctggaagcaggcaagttcgaggacaaactcatccagagtgtcatgggtgcccgcaactttgtgttggtgctatcacctggagcactggacaagtgcatgcaagaccatgactgcaaggattgggtgcataaggagattgtgactgctttaagctgcggcaagaacattgtgcccatcattgatggcttcgagtggcctgagccccaggtcctgcctgaggacatgcaggctgtgcttactttcaacggtatcaagtgagccccagggccctgggaccaggggggtagggtacaaatcaccatgacaggcagagtgtgggcaaacagctgactagcagctccctctgcccagctgtctgaaccacattggctcctgtgcccacaggtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgaaggaaggcagcctcagacaggaattaaggcaatgcccaggcgggcctgggcactgtattctgagcaagggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggctgcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctccaggggatgatttctggctctttgtctccaatcagtcccactccctcctgaggtccccaagggcagtattcagagaggtttcctgcattttatttctatttggtataccctccactgttgtccactgccctgtgtggccttctggttgacctctgcccgatcttctgtctctctgagggaatcagagtccagcatccagccccagctggaacagctgaagtcacaagcctcctctaagccaaggccagtgtgttcagaggtgactgccacccatactaggacaaacacagctcagatcaccaggtcaagcacctaggcctggcttctcctgagacagaggactcagaagtggcctttcctccaaagcctgctcagacacaggtctgtagggccagggtgttctgcttggctgggctgcagctgctacccctcggttggggctgagtcagccagatcctccccctacttctccccaagggccaagaactgctcagggacattaaaggtcaaaagtccagccacactcattcatcctttccccaggcccatgaagagaggcatctcattgtagaatgtatgaggaagtgggaagtatctcagagaatcagctaagtttcctaacttgtccatccaaatgtgatcaccacgattcaacaatttggggcattgctgatctagccgttcctagtggggcttgctcaaggttgcacagcgagtcagtagaagccctggctggccccacttggtaccaatccaccaggcagctcagggctcctgcccagcccagcagcttctgttgtctaacgtatggcaggcagactgggagcaggaaaacagagggccccaaagcccaaggcaccagaaggtttgtttcagtttgctgaagctgatttgtaatgattggcactcttcagccaggggagtgggtaggccatagccaaggatcgattccccaaccacagcaaaggcaacactcttcctccagagatcaccaagcccctcttacctccctccctccttcccaaggctggcactaaccaggtaccacattcattgttaaggaatggctgatgactgctacacgtgttgggaacctggttggggctgtgcagtttgggctggaaggagagatgccagccctcgtgctgcctctggtccctgaagtgtcacctctctcaggacctctcctctggcctgtggggttataagtgatggatagcagaaagggagaactgactcctgtcccaaatagctcctctgccacctgtcctgcagtgggcctgtgtgggttatgattctagatcctagacagaggctgggtcagctgtggatggggtggtgccttggtctctcttgactacctcgtccaaagagagcactgcccttagacaagagttgcttgtcctgctgtgggctgggcttccagctgcagacctccagttgcttggtgttcactttgctcctcttgccctctgtcttctggtccaggcagatcaggggctctggggaaactgctggaactcgaggtgaggatcagccttttccagcatcctgtgagagaccagagagagagtttggatttcatgtggggaaccctcaaggcctgtctggagaagtgacacaggatttactggggtgggctggtccaggtagctctcctgaacctcctccttccccaagctgagaagctgagagctggaggacaatatccagggacatggctctggaaaataactttttttttttaagagacagggtcttgctctgttgtccaggctggagggcagtgacataatcatagctcactgtacccttgaactcctgggctcaagtgatcctcctgcctcagcctccttagtagctgggactaccagtgcataccaccatgcctgggtgattttttaaattttttatacagacaaggtcttgctatgttgcccaggctgatcttgaattcccgggctcaagtggtcctcctgcctcagcctcccacaggatcgggattacaggcaagagcctccacgcccggccatgaaatataattcttaatatcatacaggaaaaagtcagcgggtcaagctagcctgtggcccagccacaactagctgacaaagcttcctggccttccctttaacacagttctgctgccatagttccatctataaaatgggaatggagggaaataggggaactgggagagagaacacagccttgccaagcagcaatgttagcctgatccttcctccacctagctcgccatctcgcccttggaaaatggctcctggaggattaggcagccatctgcaaggagaggggcaacctgggacaagacacccagagggtaaggattccaggaatgaagctgccatttctggttgggaggagaagaggaaacttttaagagaaagggctccattatgagcatgggttcagggccctgcattacccaatcagaacagccgggatgagcaggaggccagctcccaggaggaaggggaaccccttcataaagttcagagtggctgggtagagtgagttgaagatgccggaggccgtcagcatggccaggctattcacacaggccacagcagaaaagagagcacctgtgaagaaataaataccatactctggagtccgaaagggccatattccaactctggcaccaccacctcacagctgtgtgaccgggagtagtcacttaacctatgtctccccttcctcaccagtaaatcctgctacatcatgtactgtgacaaggattcagtaaggtcatatgtggacagtagctggcacagaggggctactaaacaaatggctgctattaaatccacattaaaagtacatgtgatctgacagaacccagcacataaaagaaaaaaaaaagtacatgtgatattgtct

SEQ ID NO: 358390 - DNA, 6173 bp, Homo sapiens
ggacccagaggcggggcgtcggcccggggaccactgctcctccggggcgtggctgcaggaggctggaggagccccgcgggacccagaggcggggcgtcggccggggaccgctgctcctccggggcgtggctgctgccgagcatctcccagctcagccgagcccgtgcccaggccacgctttgttccagccgccgcctcctctaccctacggcgtccggagccatccctcgcctgctcgctctctcctttcgcccactccctgcatctgggcctgcatcacctttgccaaccgctcccccgatcctgccgacactcctcccccaaacttctgaccggcacccttgcctggtacccttctctccattcctccccctccatcttctttccccgacccctctcgggtccctcttttcccaaaacccgggtctctccgcgtggccccgcctccaggccggggatgtcccccgcggccccgcgcccatggtcctgacgctgcttctctccgcctacaagctgtgtcgcttcttcgccatgtcgggcccacggccgggcgccgagcggctggcggtgcctgggccagatgggggcggtggcacgggcccatggtgggctgcgggtggcccgggcccgcgaaagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctgcggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccgagaccgcgtggcgcgcattgggctgggcgtgatcctgaacctggcgaaggaacgcgaacccgtagagctggcgcggagcgtggcaggcatcttggagcacatgttcaagcattcggaggagacatgccagaggctggtggcggccggcggcctggacgcggtgctgtattggtgccgccgcacggaccccgcgctgctgcgccactgcgcgctggcgctgggcaactgcgcgctgcacgggggccaggcggtgcagcgacgcatggtagagaagcgcgcagccgagtggctcttcccgctcgccttctccaaggaggacgagctgcttcggctgcacgcctgcctcgcagtagcggtgttggcgactaacaaggaggtggagcgcgaggtggagcgctcgggcacgctggcgctcgtggagccgcttgtggcctcgctggaccctggccgcttcgcccgctgtctggtggacgccagcgacacaagccagggccgcgggcccgacgacctgcagcgcctcgtgccgttgctcgactctaaccgcttggaggcgcagtgcatcggggctttctacctctgcgccgaggctgccatcaagagcctgcaaggcaagaccaaggtgttcagcgacatcggcgccatccagagcctgaaacgcctggtttcctactctaccaatggcactaagtcggcgctggccaagcgcgcgctgcgcctgctgggcgaggaggtgccacggcccatcctgccctccgtgcccagctggaaggaggccgaggttcagacgtggctgcagcagatcggtttctccaagtactgcgagagcttccgggagcagcaggtggatggcgacctgcttctgcggctcacggaggaggaactccagaccgacctgggcatgaaatcgggcatcacccgcaagaggttctttagggagctcacggagctcaagaccttcgccaactattctacgtgcgaccgcagcaacctggcggactggctgggcagcctggacccgcgcttccgtcagtacacctacggcctggtcagctgcggcctggaccgctccctgctgcaccgcgtgtctgagcagcagctgctggaagactgcggcatccacctgggcgtgcaccgcgcccgcatcctcacggcggccagagaaatgctacactccccgctgccctgtactggtggcaaacccagtggggacactccagatgtcttcatcagctaccgccggaactcaggttcccagctggccagtctcctgaaggtgcacctgcagctgcatggcttcagtgtcttcattgatgtggagaagctggaagcaggcaagttcgaggacaaactcatccagagtgtcatgggtgcccgcaactttgtgttggtgctatcacctggagcactggacaagtgcatgcaagaccatgactgcaaggattgggtgcataaggagattgtgactgctttaagctgcggcaagaacattgtgcccatcattgatggcttcgagtggcctgagccccaggtcctgcctgaggacatgcaggctgtgcttactttcaacggtatcaagtgagccccagggccctgggaccaggggggtagggtacaaatcaccatgacaggcagagtgtgggcaaacagctgactagcagctccctctgcccagctgtctgaaccacattggctcctgtgcccacaggtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgaaggaaggcagcctcagacaggaattaaggcaatgcccaggcgggcctgggcactgtattctgagcaagggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggctgcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctccaggggatgatttctggctctttgtctccaatcagtcccactccctcctgaggtccccaagggcagtattcagagaggtttcctgcattttatttctatttggtataccctccactgttgtccactgccctgtgtggccttctggttgacctctgcccgatcttctgtctctctgagggaatcagagtccagcatccagccccagctggaacagctgaagtcacaagcctcctctaagccaaggccagtgtgttcagaggtgactgccacccatactaggacaaacacagctcagatcaccaggtcaagcacctaggcctggcttctcctgagacagaggactcagaagtggcctttcctccaaagcctgctcagacacaggtctgtagggccagggtgttctgcttggctgggctgcagctgctacccctcggttggggctgagtcagccagatcctccccctacttctccccaagggccaagaactgctcagggacattaaaggtcaaaagtccagccacactcattcatcctttccccaggcccatgaagagaggcatctcattgtagaatgtatgaggaagtgggaagtatctcagagaatcagctaagtttcctaacttgtccatccaaatgtgatcaccacgattcaacaatttggggcattgctgatctagccgttcctagtggggcttgctcaaggttgcacagcgagtcagtagaagccctggctggccccacttggtaccaatccaccaggcagctcagggctcctgcccagcccagcagcttctgttgtctaacgtatggcaggcagactgggagcaggaaaacagagggccccaaagcccaaggcaccagaaggtttgtttcagtttgctgaagctgatttgtaatgattggcactcttcagccaggggagtgggtaggccatagccaaggatcgattccccaaccacagcaaaggcaacactcttcctccagagatcaccaagcccctcttacctccctccctccttcccaaggctggcactaaccaggtaccacattcattgttaaggaatggctgatgactgctacacgtgttgggaacctggttggggctgtgcagtttgggctggaaggagagatgccagccctcgtgctgcctctggtccctgaagtgtcacctctctcaggacctctcctctggcctgtggggttataagtgatggatagcagaaagggagaactgactcctgtcccaaatagctcctctgccacctgtcctgcagtgggcctgtgtgggttatgattctagatcctagacagaggctgggtcagctgtggatggggtggtgccttggtctctcttgactacctcgtccaaagagagcactgcccttagacaagagttgcttgtcctgctgtgggctgggcttccagcagcttccccagagccgctgatctgactgtaccagaagacatgcggcaagaggagcaaagtgaacactcagcaactggaggtctgcag

SEQ ID NO: 358391 - DNA, 4554 bp, Homo sapiens
ggacccagaggcggggcgtcggcccggggaccactgctcctccggggcgtggctgcaggaggctggaggagccccgcgggacccagaggcggggcgtcggccggggaccgctgctcctccggggcgtggctgctgccgagcatctcccagctcagccgagcccgtgcccaggccacgctttgttccagccgccgcctcctctaccctacggcgtccggagccatccctcgcctgctcgctctctcctttcgcccactccctgcatctgggcctgcatcacctttgccaaccgctcccccgatcctgccgacactcctcccccaaacttctgaccggcacccttgcctggtacccttctctccattcctccccctccatcttctttccccgacccctctcgggtccctcttttcccaaaacccgggtctctccgcgtggccccgcctccaggccggggatgtcccccgcggccccgcgcccatggtcctgacgctgcttctctccgcctacaagctgtgtcgcttcttcgccatgtcgggcccacggccgggcgccgagcggctggcggtgcctgggccagatgggggcggtggcacgggcccatggtgggctgcgggtggcccgggcccgcgaaagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctgcggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccgagaccgcgtggcgcgcattgggctgggcgtgatcctgaacctggcgaaggaacgcgaacccgtagagctggcgcggagcgtggcaggcatcttggagcacatgttcaagcattcggaggagacatgccagaggctggtggcggccggcggcctggacgcggtgctgtattggtgccgccgcacggaccccgcgctgctgcgccactgcgcgctggcgctgggcaactgcgcgctgcacgggggccaggcggtgcagcgacgcatggtagagaagcgcgcagccgagtggctcttcccgctcgccttctccaaggaggacgagctgcttcggctgcacgcctgcctcgcagtagcggtgttggcgactaacaaggaggtggagcgcgaggtggagcgctcgggcacgctggcgctcgtggagccgcttgtggcctcgctggaccctggccgcttcgcccgctgtctggtggacgccagcgacacaagccagggccgcgggcccgacgacctgcagcgcctcgtgccgttgctcgactctaaccgcttggaggcgcagtgcatcggggctttctacctctgcgccgaggctgccatcaagagcctgcaaggcaagaccaaggtgttcagcgacatcggcgccatccagagcctgaaacgcctggtttcctactctaccaatggcactaagtcggcgctggccaagcgcgcgctgcgcctgctgggcgaggaggtgccacggcccatcctgccctccgtgcccagctggaaggaggccgaggttcagacgtggctgcagcagatcggtttctccaagtactgcgagagcttccgggagcagcaggtggatggcgacctgcttctgcggctcacggaggaggaactccagaccgacctgggcatgaaatcgggcatcacccgcaagaggttctttagggagctcacggagctcaagaccttcgccaactattctacgtgcgaccgcagcaacctggcggactggctgggcagcctggacccgcgcttccgtcagtacacctacggcctggtcagctgcggcctggaccgctccctgctgcaccgcgtgtctgagcagcagctgctggaagactgcggcatccacctgggcgtgcaccgcgcccgcatcctcacggcggccagagaaatgctacactccccgctgccctgtactggtggcaaacccagtggggacactccagatgtcttcatcagctaccgccggaactcaggttcccagctggccagtctcctgaaggtgcacctgcagctgcatggcttcagtgtcttcattgatgtggagaagctggaagcaggcaagttcgaggacaaactcatccagagtgtcatgggtgcccgcaactttgtgttggtgctatcacctggagcactggacaagtgcatgcaagaccatgactgcaaggattgggtgcataaggagattgtgactgctttaagctgcggcaagaacattgtgcccatcattgatggcttcgagtggcctgagccccaggtcctgcctgaggacatgcaggctgtgcttactttcaacggtatcaagtgagccccagggccctgggaccaggggggtagggtacaaatcaccatgacaggcagagtgtgggcaaacagctgactagcagctccctctgcccagctgtctgaaccacattggctcctgtgcccacaggtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgaaggaaggcagcctcagacaggaattaaggcaatgcccaggcgggcctgggcactgtattctgagcaagggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgcccccttaaagctggctgcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctcca

SEQ ID NO: 358392 - DNA, 7430 bp, Homo sapiens
ggacccagaggcggggcgtcggcccggggaccactgctcctccggggcgtggctgcaggaggctggaggagccccgcgggacccagaggcggggcgtcggccggggaccgctgctcctccggggcgtggctgctgccgagcatctcccagctcagccgagcccgtgcccaggccacgctttgttccagccgccgcctcctctaccctacggcgtccggagccatccctcgcctgctcgctctctcctttcgcccactccctgcatctgggcctgcatcacctttgccaaccgctcccccgatcctgccgacactcctcccccaaacttctgaccggcacccttgcctggtacccttctctccattcctccccctccatcttctttccccgacccctctcgggtccctcttttcccaaaacccgggtctctccgcgtggccccgcctccaggccggggatgtcccccgcggccccgcgcccatggtcctgacgctgcttctctccgcctacaagctgtgtcgcttcttcgccatgtcgggcccacggccgggcgccgagcggctggcggtgcctgggccagatgggggcggtggcacgggcccatggtgggctgcgggtggcccgggcccgcgaaagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctgcggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccgagaccgcgtggcgcgcattgggctgggcgtgatcctgaacctggcgaaggaacgcgaacccgtagagctggcgcggagcgtggcaggcatcttggagcacatgttcaagcattcggaggagacatgccagaggctggtggcggccggcggcctggacgcggtgctgtattggtgccgccgcacggaccccgcgctgctgcgccactgcgcgctggcgctgggcaactgcgcgctgcacgggggccaggcggtgcagcgacgcatggtagagaagcgcgcagccgagtggctcttcccgctcgccttctccaaggaggacgagctgcttcggctgcacgcctgcctcgcagtagcggtgttggcgactaacaaggaggtggagcgcgaggtggagcgctcgggcacgctggcgctcgtggagccgcttgtggcctcgctggaccctggccgcttcgcccgctgtctggtggacgccagcgacacaagccagggccgcgggcccgacgacctgcagcgcctcgtgccgttgctcgactctaaccgcttggaggcgcagtgcatcggggctttctacctctgcgccgaggctgccatcaagagcctgcaaggcaagaccaaggtgttcagcgacatcggcgccatccagagcctgaaacgcctggtttcctactctaccaatggcactaagtcggcgctggccaagcgcgcgctgcgcctgctgggcgaggaggtgccacggcccatcctgccctccgtgcccagctggaaggaggccgaggttcagacgtggctgcagcagatcggtttctccaagtactgcgagagcttccgggagcagcaggtggatggcgacctgcttctgcggctcacggaggaggaactccagaccgacctgggcatgaaatcgggcatcacccgcaagaggttctttagggagctcacggagctcaagaccttcgccaactattctacgtgcgaccgcagcaacctggcggactggctgggcagcctggacccgcgcttccgtcagtacacctacggcctggtcagctgcggcctggaccgctccctgctgcaccgcgtgtctgagcagcagctgctggaagactgcggcatccacctgggcgtgcaccgcgcccgcatcctcacggcggccagagaaatgctacactccccgctgccctgtactggtggcaaacccagtggggacactccagatgtcttcatcagctaccgccggaactcaggttcccagctggccagtctcctgaaggtgcacctgcagctgcatggcttcagtgtcttcattgatgtggagaagctggaagcaggcaagttcgaggacaaactcatccagagtgtcatgggtgcccgcaactttgtgttggtgctatcacctggagcactggacaagtgcatgcaagaccatgactgcaaggattgggtgcataaggagattgtgactgctttaagctgcggcaagaacattgtgcccatcattgatggcttcgagtggcctgagccccaggtcctgcctgaggacatgcaggctgtgcttactttcaacggtatcaagtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgaaggaaggcagcctcagacaggaattaaggcaatgcccaggcgggcctgggcactgtattctgagcaagggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggctgcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctccaggggatgatttctggctctttgtctccaatcagtcccactccctcctgaggtccccaagggcagtattcagagaggtttcctgcattttatttctatttggtataccctccactgttgtccactgccctgtgtggccttctggttgacctctgcccgatcttctgtctctctgagggaatcagagtccagcatccagccccagctggaacagctgaagtcacaagcctcctctaagccaaggccagtgtgttcagaggtgactgccacccatactaggacaaacacagctcagatcaccaggtcaagcacctaggcctggcttctcctgagacagaggactcagaagtggcctttcctccaaagcctgctcagacacaggtctgtagggccagggtgttctgcttggctgggctgcagctgctacccctcggttggggctgagtcagccagatcctccccctacttctccccaagggccaagaactgctcagggacattaaaggtcaaaagtccagccacactcattcatcctttccccaggcccatgaagagaggcatctcattgtagaatgtatgaggaagtgggaagtatctcagagaatcagctaagtttcctaacttgtccatccaaatgtgatcaccacgattcaacaatttggggcattgctgatctagccgttcctagtggggcttgctcaaggttgcacagcgagtcagtagaagccctggctggccccacttggtaccaatccaccaggcagctcagggctcctgcccagcccagcagcttctgttgtctaacgtatggcaggcagactgggagcaggaaaacagagggccccaaagcccaaggcaccagaaggtttgtttcagtttgctgaagctgatttgtaatgattggcactcttcagccaggggagtgggtaggccatagccaaggatcgattccccaaccacagcaaaggcaacactcttcctccagagatcaccaagcccctcttacctccctccctccttcccaaggctggcactaaccaggtaccacattcattgttaaggaatggctgatgactgctacacgtgttgggaacctggttggggctgtgcagtttgggctggaaggagagatgccagccctcgtgctgcctctggtccctgaagtgtcacctctctcaggacctctcctctggcctgtggggttataagtgatggatagcagaaagggagaactgactcctgtcccaaatagctcctctgccacctgtcctgcagtgggcctgtgtgggttatgattctagatcctagacagaggctgggtcagctgtggatggggtggtgccttggtctctcttgactacctcgtccaaagagagcactgcccttagacaagagttgcttgtcctgctgtgggctgggcttccagctgcagacctccagttgcttggtgttcactttgctcctcttgccctctgtcttctggtccaggcagatcaggggctctggggaaactgctggaactcgaggtgaggatcagccttttccagcatcctgtgagagaccagagagagagtttggatttcatgtggggaaccctcaaggcctgtctggagaagtgacacaggatttactggggtgggctggtccaggtagctctcctgaacctcctccttccccaagctgagaagctgagagctggaggacaatatccagggacatggctctggaaaataactttttttttttaagagacagggtcttgctctgttgtccaggctggagggcagtgacataatcatagctcactgtacccttgaactcctgggctcaagtgatcctcctgcctcagcctccttagtagctgggactaccagtgcataccaccatgcctgggtgattttttaaattttttatacagacaaggtcttgctatgttgcccaggctgatcttgaattcccgggctcaagtggtcctcctgcctcagcctcccacaggatcgggattacaggcaagagcctccacgcccggccatgaaatataattcttaatatcatacaggaaaaagtcagcgggtcaagctagcctgtggcccagccacaactagctgacaaagcttcctggccttccctttaacacagttctgctgccatagttccatctataaaatgggaatggagggaaataggggaactgggagagagaacacagccttgccaagcagcaatgttagcctgatccttcctccacctagctcgccatctcgcccttggaaaatggctcctggaggattaggcagccatctgcaaggagaggggcaacctgggacaagacacccagagggtaaggattccaggaatgaagctgccatttctggttgggaggagaagaggaaacttttaagagaaagggctccattatgagcatgggttcagggccctgcattacccaatcagaacagccgggatgagcaggaggccagctcccaggaggaaggggaaccccttcataaagttcagagtggctgggtagagtgagttgaagatgccggaggccgtcagcatggccaggctattcacacaggccacagcagaaaagagagcacctgtgaagaaataaataccatactctggagtccgaaagggccatattccaactctggcaccaccacctcacagctgtgtgaccgggagtagtcacttaacctatgtctccccttcctcaccagtaaatcctgctacatcatgtactgtgacaaggattcagtaaggtcatatgtggacagtagctggcacagaggggctactaaacaaatggctgctattaaatccacattaaaagtacatgtgatctgacagaacccagcacataaaagaaaaaaaaaagtacatgtgatattgtct

SEQ ID NO: 358393 - DNA, 7560 bp, Homo sapiens
ggacccagaggcggggcgtcggcccggggaccactgctcctccggggcgtggctgcaggaggctggaggagccccgcgggacccagaggcggggcgtcggccggggaccgctgctcctccggggcgtggctgctgccgagcatctcccagctcagccgagcccgtgcccaggccacgctttgttccagccgccgcctcctctaccctacggcgtccggagccatccctcgcctgctcgctctctcctttcgcccactccctgcatctgggcctgcatcacctttgccaaccgctcccccgatcctgccgacactcctcccccaaacttctgaccggcacccttgcctggtacccttctctccattcctccccctccatcttctttccccgacccctctcgggtccctcttttcccaaaacccgggtctctccgcgtggccccgcctccaggccggggatgtcccccgcggccccgcgcccatggtcctgacgctgcttctctccgcctacaagctgtgtcgcttcttcgccatgtcgggcccacggccgggcgccgagcggctggcggtgcctgggccagatgggggcggtggcacgggcccatggtgggctgcgggtggcccgggcccgcgaaagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctgcggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccgagaccgcgtggcgcgcattgggctgggcgtgatcctgaacctggcgaaggaacgcgaacccgtagagctggcgcggagcgtggcaggcatcttggagcacatgttcaagcattcggaggagacatgccagaggctggtggcggccggcggcctggacgcggtgctgtattggtgccgccgcacggaccccgcgctgctgcgccactgcgcgctggcgctgggcaactgcgcgctgcacgggggccaggcggtgcagcgacgcatggtagagaagcgcgcagccgagtggctcttcccgctcgccttctccaaggaggacgagctgcttcggctgcacgcctgcctcgcagtagcggtgttggcgactaacaaggaggtggagcgcgaggtggagcgctcgggcacgctggcgctcgtggagccgcttgtggcctcgctggaccctggccgcttcgcccgctgtctggtggacgccagcgacacaagccagggccgcgggcccgacgacctgcagcgcctcgtgccgttgctcgactctaaccgcttggaggcgcagtgcatcggggctttctacctctgcgccgaggctgccatcaagagcctgcaaggcaagaccaaggtgttcagcgacatcggcgccatccagagcctgaaacgcctggtttcctactctaccaatggcactaagtcggcgctggccaagcgcgcgctgcgcctgctgggcgaggaggtgccacggcccatcctgccctccgtgcccagctggaaggaggccgaggttcagacgtggctgcagcagatcggtttctccaagtactgcgagagcttccgggagcagcaggtggatggcgacctgcttctgcggctcacggaggaggaactccagaccgacctgggcatgaaatcgggcatcacccgcaagaggttctttagggagctcacggagctcaagaccttcgccaactattctacgtgcgaccgcagcaacctggcggactggctgggcagcctggacccgcgcttccgtcagtacacctacggcctggtcagctgcggcctggaccgctccctgctgcaccgcgtgtctgagcagcagctgctggaagactgcggcatccacctgggcgtgcaccgcgcccgcatcctcacggcggccagagaaatgctacactccccgctgccctgtactggtggcaaacccagtggggacactccagatgtcttcatcagctaccgccggaactcaggttcccagctggccagtctcctgaaggtgcacctgcagctgcatggcttcagtgtcttcattgatgtggagaagctggaagcaggcaagttcgaggacaaactcatccagagtgtcatgggtgcccgcaactttgtgttggtgctatcacctggagcactggacaagtgcatgcaagaccatgactgcaaggattgggtgcataaggagattgtgactgctttaagctgcggcaagaacattgtgcccatcattgatggcttcgagtggcctgagccccaggtcctgcctgaggacatgcaggctgtgcttactttcaacggtatcaagtgagccccagggccctgggaccaggggggtagggtacaaatcaccatgacaggcagagtgtgggcaaacagctgactagcagctccctctgcccagctgtctgaaccacattggctcctgtgcccacaggtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgaaggaaggcagcctcagacaggaattaaggcaatgcccaggcgggcctgggcactgtattctgagcaagggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggctgcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctccaggggatgatttctggctctttgtctccaatcagtcccactccctcctgaggtccccaagggcagtattcagagaggtttcctgcattttatttctatttggtataccctccactgttgtccactgccctgtgtggccttctggttgacctctgcccgatcttctgtctctctgagggaatcagagtccagcatccagccccagctggaacagctgaagtcacaagcctcctctaagccaaggccagtgtgttcagaggtgactgccacccatactaggacaaacacagctcagatcaccaggtcaagcacctaggcctggcttctcctgagacagaggactcagaagtggcctttcctccaaagcctgctcagacacaggtctgtagggccagggtgttctgcttggctgggctgcagctgctacccctcggttggggctgagtcagccagatcctccccctacttctccccaagggccaagaactgctcagggacattaaaggtcaaaagtccagccacactcattcatcctttccccaggcccatgaagagaggcatctcattgtagaatgtatgaggaagtgggaagtatctcagagaatcagctaagtttcctaacttgtccatccaaatgtgatcaccacgattcaacaatttggggcattgctgatctagccgttcctagtggggcttgctcaaggttgcacagcgagtcagtagaagccctggctggccccacttggtaccaatccaccaggcagctcagggctcctgcccagcccagcagcttctgttgtctaacgtatggcaggcagactgggagcaggaaaacagagggccccaaagcccaaggcaccagaaggtttgtttcagtttgctgaagctgatttgtaatgattggcactcttcagccaggggagtgggtaggccatagccaaggatcgattccccaaccacagcaaaggcaacactcttcctccagagatcaccaagcccctcttacctccctccctccttcccaaggctggcactaaccaggtaccacattcattgttaaggaatggctgatgactgctacacgtgttgggaacctggttggggctgtgcagtttgggctggaaggagagatgccagccctcgtgctgcctctggtccctgaagtgtcacctctctcaggacctctcctctggcctgtggggttataagtgatggatagcagaaagggagaactgactcctgtcccaaatagctcctctgccacctgtcctgcagtgggcctgtgtgggttatgattctagatcctagacagaggctgggtcagctgtggatggggtggtgccttggtctctcttgactacctcgtccaaagagagcactgcccttagacaagagttgcttgtcctgctgtgggctgggcttccagctgcagacctccagttgcttggtgttcactttgctcctcttgccctctgtcttctggtccaggcagatcaggggctctggggaaactgctggaactcgaggtgaggatcagccttttccagcatcctgtgagagaccagagagagagtttggatttcatgtggggaaccctcaaggcctgtctggagaagtgacacaggatttactggggtgggctggtccaggtagctctcctgaacctcctccttccccaagctgagaagctgagagctggaggacaatatccagggacatggctctggaaaataactttttttttttaagagacagggtcttgctctgttgtccaggctggagggcagtgacataatcatagctcactgtacccttgaactcctgggctcaagtgatcctcctgcctcagcctccttagtagctgggactaccagtgcataccaccatgcctgggtgattttttaaattttttatacagacaaggtcttgctatgttgcccaggctgatcttgaattcccgggctcaagtggtcctcctgcctcagcctcccacaggatcgggattacaggcaagagcctccacgcccggccatgaaatataattcttaatatcatacaggaaaaagtcagcgggtcaagctagcctgtggcccagccacaactagctgacaaagcttcctggccttccctttaacacagttctgctgccatagttccatctataaaatgggaatggagggaaataggggaactgggagagagaacacagccttgccaagcagcaatgttagcctgatccttcctccacctagctcgccatctcgcccttggaaaatggctcctggaggattaggcagccatctgcaaggagaggggcaacctgggacaagacacccagagggtaaggattccaggaatgaagctgccatttctggttgggaggagaagaggaaacttttaagagaaagggctccattatgagcatgggttcagggccctgcattacccaatcagaacagccgggatgagcaggaggccagctcccaggaggaaggggaaccccttcataaagttcagagtggctgggtagagtgagttgaagatgccggaggccgtcagcatggccaggctattcacacaggccacagcagaaaagagagcacctgtgaagaaataaataccatactctggagtccgaaagggccatattccaactctggcaccaccacctcacagctgtgtgaccgggagtagtcacttaacctatgtctccccttcctcaccagtaaatcctgctacatcatgtactgtgacaaggattcagtaaggtcatatgtggacagtagctggcacagaggggctactaaacaaatggctgctattaaatccacattaaaagtacatgtgatctgacagaacccagcacataaaagaaaaaaaaaagtacatgtgatattgtct

SEQ ID NO: 358394 - DNA, 6978 bp, Homo sapiens
ggacccagaggcggggcgtcggcccggggaccactgctcctccggggcgtggctgcaggaggctggaggagccccgcgggacccagaggcggggcgtcggccggggaccgctgctcctccggggcgtggctgctgccgagcatctcccagctcagccgagcccgtgcccaggccacgctttgttccagccgccgcctcctctaccctacggcgtccggagccatccctcgcctgctcgctctctcctttcgcccactccctgcatctgggcctgcatcacctttgccaaccgctcccccgatcctgccgacactcctcccccaaacttctgaccggcacccttgcctggtacccttctctccattcctccccctccatcttctttccccgacccctctcgggtccctcttttcccaaaacccgggtctctccgcgtggccccgcctccaggccggggatgtcccccgcggccccgcgcccatggtcctgacgctgcttctctccgcctacaagctgtgtcgcttcttcgccatgtcgggcccacggccgggcgccgagcggctggcggtgcctgggccagatgggggcggtggcacgggcccatggtgggctgcgggtggcccgggcccgcgaaagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctgcggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccgagaccgcgtggcgcgcattgggctgggcgtgatcctgaacctggcgaaggaacgcgaacccgtagagctggcgcggagcgtggcaggcatcttggagcacatgttcaagcattcggaggagacatgccagaggctggtggcggccggcggcctggacgcggtgctgtattggtgccgccgcacggaccccgcgctgctgcgccactgcgcgctggcgctgggcaactgcgcgctgcacgggggccaggcggtgcagcgacgcatggtagagaagcgcgcagccgagtggctcttcccgctcgccttctccaaggaggacgagctgcttcggctgcacgcctgcctcgcagtagcggtgttggcgactaacaaggaggtggagcgcgaggtggagcgctcgggcacgctggcgctcgtggagccgcttgtggcctcgctggaccctggccgcttcgcccgctgtctggtggacgccagcgacacaagccagggccgcgggcccgacgacctgcagcgcctcgtgccgttgctcgactctaaccgcttggaggcgcagtgcatcggggctttctacctctgcgccgaggctgccatcaagagcctgcaaggcaagaccaaggtgttcagcgacatcggcgccatccagagcctgaaacgcctggtttcctactctaccaatggcactaagtcggcgctggccaagcgcgcgctgcgcctgctgggcgaggaggtgccacggcccatcctgccctccgtgcccagctggaaggaggccgaggttcagacgtggctgcagcagatcggtttctccaagtactgcgagagcttccgggagcagcaggtggatggcgacctgcttctgcggctcacggaggaggaactccagaccgacctgggcatgaaatcgggcatcacccgcaagaggttctttagggagctcacggagctcaagaccttcgccaactattctacgtgcgaccgcagcaacctggcggactggctgggcagcctggacccgcgcttccgtcagtacacctacggcctggtcagctgcggcctggaccgctccctgctgcaccgcgtgtctgagcagcagctgctggaagactgcggcatccacctgggcgtgcaccgcgcccgcatcctcacggcggccagagaaatgctacactccccgctgccctgtactggtggcaaacccagtggggacactccagatgtcttcatcagctaccgccggaactcaggttcccagctggccagtctcctgaaggtgcacctgcagctgcatggcttcagtgtcttcattgatgtggagaagctggaagcaggcaagttcgaggacaaactcatccagagtgtcatgggtgcccgcaactttgtgttggtgctatcacctggagcactggacaagtgcatgcaagaccatgactgcaaggattgggtgcataaggagattgtgactgctttaagctgcggcaagaacattgtgcccatcattgatggcttcgagtggcctgagccccaggtcctgcctgaggacatgcaggctgtgcttactttcaacggtatcaagtgagccccagggccctgggaccaggggggtagggtacaaatcaccatgacaggcagagtgtgggcaaacagctgactagcagctccctctgcccagctgtctgaaccacattggctcctgtgcccacaggtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgaaggaaggcagcctcagacaggaattaaggcaatgcccaggcgggcctgggcactgtattctgagcaagggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggctgcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctccccctacttctccccaagggccaagaactgctcagggacattaaaggtcaaaagtccagccacactcattcatcctttccccaggcccatgaagagaggcatctcattgtagaatgtatgaggaagtgggaagtatctcagagaatcagctaagtttcctaacttgtccatccaaatgtgatcaccacgattcaacaatttggggcattgctgatctagccgttcctagtggggcttgctcaaggttgcacagcgagtcagtagaagccctggctggccccacttggtaccaatccaccaggcagctcagggctcctgcccagcccagcagcttctgttgtctaacgtatggcaggcagactgggagcaggaaaacagagggccccaaagcccaaggcaccagaaggtttgtttcagtttgctgaagctgatttgtaatgattggcactcttcagccaggggagtgggtaggccatagccaaggatcgattccccaaccacagcaaaggcaacactcttcctccagagatcaccaagcccctcttacctccctccctccttcccaaggctggcactaaccaggtaccacattcattgttaaggaatggctgatgactgctacacgtgttgggaacctggttggggctgtgcagtttgggctggaaggagagatgccagccctcgtgctgcctctggtccctgaagtgtcacctctctcaggacctctcctctggcctgtggggttataagtgatggatagcagaaagggagaactgactcctgtcccaaatagctcctctgccacctgtcctgcagtgggcctgtgtgggttatgattctagatcctagacagaggctgggtcagctgtggatggggtggtgccttggtctctcttgactacctcgtccaaagagagcactgcccttagacaagagttgcttgtcctgctgtgggctgggcttccagctgcagacctccagttgcttggtgttcactttgctcctcttgccctctgtcttctggtccaggcagatcaggggctctggggaaactgctggaactcgaggtgaggatcagccttttccagcatcctgtgagagaccagagagagagtttggatttcatgtggggaaccctcaaggcctgtctggagaagtgacacaggatttactggggtgggctggtccaggtagctctcctgaacctcctccttccccaagctgagaagctgagagctggaggacaatatccagggacatggctctggaaaataactttttttttttaagagacagggtcttgctctgttgtccaggctggagggcagtgacataatcatagctcactgtacccttgaactcctgggctcaagtgatcctcctgcctcagcctccttagtagctgggactaccagtgcataccaccatgcctgggtgattttttaaattttttatacagacaaggtcttgctatgttgcccaggctgatcttgaattcccgggctcaagtggtcctcctgcctcagcctcccacaggatcgggattacaggcaagagcctccacgcccggccatgaaatataattcttaatatcatacaggaaaaagtcagcgggtcaagctagcctgtggcccagccacaactagctgacaaagcttcctggccttccctttaacacagttctgctgccatagttccatctataaaatgggaatggagggaaataggggaactgggagagagaacacagccttgccaagcagcaatgttagcctgatccttcctccacctagctcgccatctcgcccttggaaaatggctcctggaggattaggcagccatctgcaaggagaggggcaacctgggacaagacacccagagggtaaggattccaggaatgaagctgccatttctggttgggaggagaagaggaaacttttaagagaaagggctccattatgagcatgggttcagggccctgcattacccaatcagaacagccgggatgagcaggaggccagctcccaggaggaaggggaaccccttcataaagttcagagtggctgggtagagtgagttgaagatgccggaggccgtcagcatggccaggctattcacacaggccacagcagaaaagagagcacctgtgaagaaataaataccatactctggagtccgaaagggccatattccaactctggcaccaccacctcacagctgtgtgaccgggagtagtcacttaacctatgtctccccttcctcaccagtaaatcctgctacatcatgtactgtgacaaggattcagtaaggtcatatgtggacagtagctggcacagaggggctactaaacaaatggctgctattaaatccacattaaaagtacatgtgatctgacagaacccagcacataaaagaaaaaaaaaagtacatgtgatattgtct

SEQ ID NO: 358395 - DNA, 4661 bp, Homo sapiens
ggacccagaggcggggcgtcggcccggggaccactgctcctccggggcgtggctgcaggaggctggaggagccccgcgggacccagaggcggggcgtcggccggggaccgctgctcctccggggcgtggctgctgccgagcatctcccagctcagccgagcccgtgcccaggccacgctttgttccagccgccgcctcctctaccctacggcgtccggagccatccctcgcctgctcgctctctcctttcgcccactccctgcatctgggcctgcatcacctttgccaaccgctcccccgatcctgccgacactcctcccccaaacttctgaccggcacccttgcctggtacccttctctccattcctccccctccatcttctttccccgacccctctcgggtccctcttttcccaaaacccgggtctctccgcgtggccccgcctccaggccggggatgtcccccgcggccccgcgcccatggtcctgacgctgcttctctccgcctacaagctgtgtcgcttcttcgccatgtcgggcccacggccgggcgccgagcggctggcggtgcctgggccagatgggggcggtggcacgggcccatggtgggctgcgggtggcccgggcccgcgaaagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctgcggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccgagaccgcgtggcgcgcattgggctgggcgtgatcctgaacctggcgaaggaacgcgaacccgtagagctggcgcggagcgtggcaggcatcttggagcacatgttcaagcattcggaggagacatgccagaggctggtggcggccggcggcctggacgcggtgctgtattggtgccgccgcacggaccccgcgctgctgcgccactgcgcgctggcgctgggcaactgcgcgctgcacgggggccaggcggtgcagcgacgcatggtagagaagcgcgcagccgagtggctcttcccgctcgccttctccaaggaggacgagctgcttcggctgcacgcctgcctcgcagtagcggtgttggcgactaacaaggaggtggagcgcgaggtggagcgctcgggcacgctggcgctcgtggagccgcttgtggcctcgctggaccctggccgcttcgcccgctgtctggtggacgccagcgacacaagccagggccgcgggcccgacgacctgcagcgcctcgtgccgttgctcgactctaaccgcttggaggcgcagtgcatcggggctttctacctctgcgccgaggctgccatcaagagcctgcaaggcaagaccaaggtgttcagcgacatcggcgccatccagagcctgaaacgcctggtttcctactctaccaatggcactaagtcggcgctggccaagcgcgcgctgcgcctgctgggcgaggaggtgccacggcccatcctgccctccgtgcccagctggaaggaggccgaggttcagacgtggctgcagcagatcggtttctccaagtactgcgagagcttccgggagcagcaggtggatggcgacctgcttctgcggctcacggaggaggaactccagaccgacctgggcatgaaatcgggcatcacccgcaagaggttctttagggagctcacggagctcaagaccttcgccaactattctacgtgcgaccgcagcaacctggcggactggctgggcagcctggacccgcgcttccgtcagtacacctacggcctggtcagctgcggcctggaccgctccctgctgcaccgcgtgtctgagcagcagctgctggaagactgcggcatccacctgggcgtgcaccgcgcccgcatcctcacggcggccagagaaatgctacactccccgctgccctgtactggtggcaaacccagtggggacactccagatgtcttcatcagctaccgccggaactcaggttcccagctggccagtctcctgaaggtgcacctgcagctgcatggcttcagtgtcttcattgatgtggagaagctggaagcaggcaagttcgaggacaaactcatccagagtgtcatgggtgcccgcaactttgtgttggtgctatcacctggagcactggacaagtgcatgcaagaccatgactgcaaggattgggtgcataaggagattgtgactgctttaagctgcggcaagaacattgtgcccatcattgatggcttcgagtggcctgagccccaggtcctgcctgaggacatgcaggctgtgcttactttcaacggtatcaagtgagccccagggccctgggaccaggggggtagggtacaaatcaccatgacaggcagagtgtgggcaaacagctgactagcagctccctctgcccagctgtctgaaccacattggctcctgtgcccacaggtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgaaggaaggcagcctcagacaggaattaaggcaatgcccaggcgggcctgggcactgtattctgagcaagggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggctgcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctcca

SEQ ID NO: 358396 - DNA, 5523 bp, Homo sapiens
ggacccagaggcggggcgtcggcccggggaccactgctcctccggggcgtggctgcaggaggctggaggagccccgcgggacccagaggcggggcgtcggccggggaccgctgctcctccggggcgtggctgctgccgagcatctcccagctcagccgagcccgtgcccaggccacgctttgttccagccgccgcctcctctaccctacggcgtccggagccatccctcgcctgctcgctctctcctttcgcccactccctgcatctgggcctgcatcacctttgccaaccgctcccccgatcctgccgacactcctcccccaaacttctgaccggcacccttgcctggtacccttctctccattcctccccctccatcttctttccccgacccctctcgggtccctcttttcccaaaacccgggtctctccgcgtggccccgcctccaggccggggatgtcccccgcggccccgcgcccatggtcctgacgctgcttctctccgcctacaagctgtgtcgcttcttcgccatgtcgggcccacggccgggcgccgagcggctggcggtgcctgggccagatgggggcggtggcacgggcccatggtgggctgcgggtggcccgggcccgcgaaagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctgcggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccgagaccgcgtggcgcgcattgggctgggcgtgatcctgaacctggcgaaggaacgcgaacccgtagagctggcgcggagcgtggcaggcatcttggagcacatgttcaagcattcggaggagacatgccagaggctggtggcggccggcggcctggacgcggtgctgtattggtgccgccgcacggaccccgcgctgctgcgccactgcgcgctggcgctgggcaactgcgcgctgcacgggggccaggcggtgcagcgacgcatggtagagaagcgcgcagccgagtggctcttcccgctcgccttctccaaggaggacgagctgcttcggctgcacgcctgcctcgcagtagcggtgttggcgactaacaaggaggtggagcgcgaggtggagcgctcgggcacgctggcgctcgtggagccgcttgtggcctcgctggaccctggccgcttcgcccgctgtctggtggacgccagcgacacaagccagggccgcgggcccgacgacctgcagcgcctcgtgccgttgctcgactctaaccgcttggaggcgcagtgcatcggggctttctacctctgcgccgaggctgccatcaagagcctgcaaggcaagaccaaggtgttcagcgacatcggcgccatccagagcctgaaacgcctggtttcctactctaccaatggcactaagtcggcgctggccaagcgcgcgctgcgcctgctgggcgaggaggtgccacggcccatcctgccctccgtgcccagctggaaggaggccgaggttcagacgtggctgcagcagatcggtttctccaagtactgcgagagcttccgggagcagcaggtggatggcgacctgcttctgcggctcacggaggaggaactccagaccgacctgggcatgaaatcgggcatcacccgcaagaggttctttagggagctcacggagctcaagaccttcgccaactattctacgtgcgaccgcagcaacctggcggactggctgggcagcctggacccgcgcttccgtcagtacacctacggcctggtcagctgcggcctggaccgctccctgctgcaccgcgtgtctgagcagcagctgctggaagactgcggcatccacctgggcgtgcaccgcgcccgcatcctcacggcggccagagaaatgctacactccccgctgccctgtactggtggcaaacccagtggggacactccagatgtcttcatcagctaccgccggaactcaggttcccagctggccagtctcctgaaggtgcacctgcagctgcatggcttcagtgtcttcattgatgtggagaagctggaagcaggcaagttcgaggacaaactcatccagagtgtcatgggtgcccgcaactttgtgttggtgctatcacctggagcactggacaagtgcatgcaagaccatgactgcaaggattgggtgcataaggagattgtgactgctttaagctgcggcaagaacattgtgcccatcattgatggcttcgagtggcctgagccccaggtcctgcctgaggacatgcaggctgtgcttactttcaacggtatcaagtgagccccagggccctgggaccaggggggtagggtacaaatcaccatgacaggcagagtgtgggcaaacagctgactagcagctccctctgcccagctgtctgaaccacattggctcctgtgcccacaggtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgaaggaaggcagcctcagacaggaattaaggcaatgcccaggcgggcctgggcactgtattctgagcaagggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggctgcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaacagagaagcgaggagacaaaagaaaacacagcgagagagagaagcagaggagcgaagaacaagaaaacgagcgacaacagcgagagccggacaggacacaagcgcgaggagcgggactgccaatacaaagagaagcagcgagggagccaccaacacagagcgagcagaggagccacagacagagagaagaaacaaaaagggagagaacacaaccgaggaggggacaggaccaaaagaaaaaaacaaagcaacgaaaaaagaaaaagcgaggcgaagagaaatgcgtggacaagacccgcgaacagatatggtgcaacagagcgacagaagacgactagccgacgagagcgcagaggaagaccgagcagatgagacagacagagcgcgcacaacaaagaggcgcggcgtcggctaccaacagggaacggacggcgagcggggggacgggagggccgaaagggacggcggagagggagggagagaagagcagcggccgcgggcgagaagacggggggcagggcggcgaaaggggagcgggagcccgagacagacaagaccaaagctcggggaggcagcaggcaagcaggaaacagcggaggaagacgacgagaaccggcacaagggagagagaaggagcgagagagagagggcggggagggagccgagcgcgaccacggagcgaagaggcagggaagggaagcaaggaaggacagacagaaccggagaggacgagagaacagacagcaccagaggcggcgccagcag

SEQ ID NO: 358397 - DNA, 184 bp, Homo sapiens
ttattagctagggaaatgggaggtgcagtggttaaatgcatgggctcaggagtcatactagacctggttagagggcttcgtcctagccctgtgatcttgagcaagttacctaaccattctgggctctctttgcttctctgcaaactgaggataataaaacagtgcctacgtcataggcttgcca

SEQ ID NO: 358398 - DNA, 235 bp, Homo sapiens
tatgtaaatacacaaaccctgactggatgggaaaagaggctataaaaatacttcagtgacaatatgtaaatacagaaaccccgactggatgggaaagaggctataaaaatacattttgtgggcctacagcagctgctcacgcctataatcccaacactttgggaggctgaggtgagcacttgaacccagaagttgaagaccagcctgtgcaatatgatgaaaccctgtctctaca

SEQ ID NO: 358399 - DNA, 651 bp, Homo sapiens
gaagcatttgtggtacagagcttggagtttggagtaaggcttccttgttttgcatcctggctctaccactgtcaatctgtgtgaccttgggtgagtcacttaactgtttcctcacctgttaaatgtgaataataacagtacctctccccttttgtgaagactgaatgagataaatgaaaagctgtttgcagtatggtcatactaaaatgggagcagtcagtaccctccccccatttccagcagagtggtgggcaggtctagctagcccttgtacatacaccttgcagaatagtttatagtagtgagcatagctggtaaatgtacaataaaaaaagttcctgtttttcatttctacctgattgaatgagacacctatttaatgcaaatttcaataatgctctgatactaactctgttcaagttagtaagagagctttgtagagttattgtgacacctgggttaagtatggctgactttgggttaagtatgaggtctaatcatcccagtctgtcctctagattttttgctgttttgttcaatataattatgtaaacaggtattctctatgtaaacatttgtgaaagttaaaataccaaagcagattaaatatagaactagactggatgcctacatcagtgttttagtgacagc

SEQ ID NO: 358400 - DNA, 421 bp, Homo sapiens
acacatttggtaagagaatatcctgatctgctttgcatgtgaggctctcccagtaataaacaaagaagcataatcaaacaagattttaatttctctatgccctgttagaaattcagatataattcaagtcatcttggaaattttaagttgcattctgatgtcgtctctgttctggccattgtgcaatgggccttcaaatgttgtagtagaggccaactgatattccattgttattcatttatacacaggtacatatatggtgtgtgtacgcaaatatataaatattcatatatgtgtacatgtgtacatacatacatatggaggtaatacaagtttgcattgtttttaaaattattttacccaaattaacaatgactctattgcatatctttattggttatatcacatttatataaataaa

SEQ ID NO: 358401 - DNA, 162 bp, Homo sapiens
ttggctgactgccctgattgcctgcctgccccctcccctgcggagagccttagccctccacttccggtcagcacctgggcctggagctgggagtttctctctgcagagctgcctggagggggatgagtgagctgttgacttcttggctctcattagctcttc

SEQ ID NO: 358402 - DNA, 448 bp, Homo sapiens
agccaggatggtctcgatctcctgacctcgtgatccgcctgcctctgcctcccaaagtgctgggattgcaggtgtgagccaccgcacccagcggaacttctttttaactaaataaagaaaattagttcagattttttggcctttacttcttcattatgtacatgaattttaaagaaaaacagtaaaaacctcagtttagtattctgttgtaacacatttgccattggtttttattttaaacctctctgtagacctcatatggcaatatacagaaatgttactaaatcaccttgccaaaaaatcaagcagtgtaaattaggccaccaaaggcattggaggaacagttcagataaccttaaaatactgaaatgaatcttacaaaaattgtaggtgaccagttcacatttgttttatccttatttcttaatctttatatgtcttgaaattc

SEQ ID NO: 358403 - DNA, 566 bp, Homo sapiens
gtttgtgtatgtgtttatttacttttgttattacagttcagtaaattttttatgagactatacaggtttggagtgttttctccaatcccagctttcttgtatgtcctgttctttttattatgcacaattccatctcttggtggttttagaaccatataccacatgaagggtgaaatttcttcatactgatcactgcttactcctctgtgtttggctcactttttctttttctttgtcttttctccctccttttcctccttcattccttctttttttttttttgacttctggcttttggagatttccctcactttcttctgatcccagcaaggcatttaaagtcatgttggttgtaatttatgtaggattcagtttttagcagcaggaccttgcagaatattcaatctactgcactcccagaaatgaaagtctctccccacctttcctcttgcataaatttgtggaagtctctcattcgtcgtcgatggtcttttctgattttcttcattgtcattgactttgtcccttttcattccttcagttccatcttaatgtggtcactggag

SEQ ID NO: 358404 - DNA, 692 bp, Homo sapiens
ctgtgctaattgggactgggaagggtttgccaaggattggagctgcagactccagtgctcagagcagcaggatggcacttggtgtctggatgcctttggagttgcacatacagcttctttatgaaaggaagaaactggaagacaacaaagggtcagagaggagggagaaggctgtgctaaacaaggtgctggcagtgtcaggagctggcctcctgccttctgggttgagagatatcgaatgctgctttgccaagagctgctttcttgagcccctccaaggttctcctatttggactctgctgcagatcccttgccctggttctcctcctgttgccaaggcccaggctactgtctgggcaagagcacacatagggtttgaaaccttccagaacaaaatgccagtctacctcctcctatctggaatctaaggcctaacccatcactgcacctgatgacaaggacctgcagtgctgcagagaaaaagcatatcaatgtggaatgtataatttacagtcaagctggaagactacagcaacttaaatggtactaggcacggaacgggcaggaaatcaaaagtcatcaaggaaagttggaggatattccagagattgcaacataagccccagaggttcaatgtatttgctgagtaagggccttttagaaaaacaagtctgtgggttgatattattggc

SEQ ID NO: 358405 - DNA, 641 bp, Homo sapiens
ctgtgctaattgggactgggaagggtttgccaaggattggagctgcagactccagtgctcagagcagcaggatggcacttggtgtctggatgcctttggagttgcacatacagcttctttatgaaaggaagaaactggaagacaacaaagagacaccgccagccacataaatggccattgcaactgccattgaaaatccaacattgatagtgatgacccctccaaaacgtcctcgactgagaatagcttgggcaacacagccacatccaaggacctggaatgagaggaaaactcaacagatgctgaaatggcttttcttaggaggataatcaatgctgtgtgctgcaggaaataggaggagtgatgagcaatgtggggacttcagttaccctcatcagaatcgccactcagaagattggagcccagatttccagcattacatcttaatttagaaatgttttattgtagcctgaaaagcaacgaggaagccaggctgcatcttggggcttctctgaggactcctgtttctaccaatacctacctgttgtggtcctcactttcacagccagatgaaaatggacgttttgacaatggctcacagattcctggagatgtctggtaagagtctctgactgtacaaa

SEQ ID NO: 358406 - DNA, 414 bp, Homo sapiens
ctgtgctaattgggactgggaagggtttgccaaggattggagctgcagactccagtgctcagagcagcaggatggcacttggtgtctggatgcctttggagttgcacatacagcttctttatgaaaggaagaaactggaagacaacaaagggtcagagaggagggagaaggctgtgctaaacaaggtgctggcagtgtcaggagctggcctcctgccttctgggttgagagatatcgaatgctgctttgccaagagctgctttcttgagcccctccaaggttctcctatttggactctgctgcagatcccttgccctggtcagcagctacttaatcagaaagatcaactcaacattttcccttgacccaattagattatcgaatctccaataaacgtcatctgttatctctgga

SEQ ID NO: 358407 - DNA, 464 bp, Homo sapiens
tatcatctgtgctaattgggactgggaagggtttgccaaggattggagctgcagactccagtgctcagagcagcaggatggcacttggtgtctggatgcctttggagttgcacatacagcttctttatgaaaggaagaaactggaagacaacaaaggtagggttctatttcaagccagagtaaaagaaagaaatgcagacaatgagccacaaccttccacctcgggggtcaccacatctcagcctgagaatgacgttgtcccttcttactacctcttctccacagcatttgaccacagcaagcacgtttaaatgttttgtctatgattacaatattatttatttatagaaaacaaaaaatggcagtagcgtttgtgtatgtgtttatttacttttgttattacagttcagtaaattttttatgagactatacaggtttggagtgttttctccaatcccagcttt

SEQ ID NO: 358408 - DNA, 2035 bp, Homo sapiens
ccaatcgctagcaaactccctgcctagcaaggcccagcctggggcagaaatggctgcaagtggccgaggtctctgcaaggctgtggccgcctctcccttcccggcgtggagacgagataacacggaagccaggggaggtctgaagcctgagtatgatgcggtggtgataggagcaggacacaacggactggtggctgcagcgtacctgcagagactgggggtgaacaccgccgtcttcgagaggcgccatgtgatcgggggtgcagctgtcactgaggagatcatcccagggtttaagttctcccgtgcgtcctacctgctcagcctgctgaggccgcagatttacactgatctggagctgaagaaacatgggctgaggcttcatcttcgaaacccctactccttcacccccatgctggaagagggtgcaggcagcaaggtgcccaggtgccttctgctgggcacagacatggcagaaaaccagaagcagatcgcccagttctcccagaaggatgcccaggtctttcccaaatatgaggagttcatgcatcgcttggcattagccattgaccctctgctggatgcggcccccgtggacatggcggccttccagcatggctccttgctgcaaaggatgaggtcgctctccaccctcaagcccctgctgaaggcaggccgcatcctgggagcccagcttccccgatattatgaggtcctcacagctcccattaccaaggtgctggatcagtggttcgagtctgagcctttaaaagccactctagccacagatgcagtgattggagccatgacaagtccccacactccggggagtgggtatgtgctgctgcaccatgtgatggggggcctggagggaatgcagggggcctggggctacgtccaggggggcatgggtgccctctctgatgcgatcgcaagctcagccaccacacatggagcaagcatcttcactgaaaagacagtggcgaaggtgcaggtgaacagtgaaggctgtgttcaaggagttgtgctggaagatggcacagaggtgagaagcaaaatggtgctgtccaacacatcaccgcagatcaccttcctgaagctgacgccacaggagtggcttcctgaggagttcctggagagaatctctcagctggacacccggtcgcctgtcaccaagatcaatgtggccgtagacaggctgcccagcttcctggcggcccccaatgctcccaggggccagccgctgccccatcaccaatgctccatccacctgaactgtgaagacaccctcctccttcatcaggcctttgaagatgccatggatggcctgccttcccacaggcctgtgattgagctctgcatcccttcctcgctggaccccaccctggctccccctggctgccatgtagtctccctcttcactcagtacacgccctatacgctggctggaggcaaggcctgggacgagcaggagagagacgcttatgcagacagagtgtttgattgcatcgaggtctatgcccctggcttcaaggactctgtggttggcagagacatcctcacaccaccagatttggagagaatcttcgggcttcctggagggaacatattccactgcgccatgtccctggaccagctctacttcgcccgccccgtgcccctgcattctggctaccgctgccctctccagggcctgtatctctgtggaagtggggctcatcctggaggaggtgtgatgggagctgctgggcgaaatgcagcacatgtggcctttagggacctcaagagcatgtgaccctgaaccagctctgacccaggaagaagactccacccctgaattccaagtgctccattggatcagcttcccaggaagttcagcttcgggttagtacataaggccaccacaatgctcaagaaattattttagaaaaaacgtacgagttacatttagtgcaagttgaccttatgcccatgcctccatacatggactggttctgttttattaaaactaatatttcatacagattaaaaagat

SEQ ID NO: 358409 - DNA, 2255 bp, Homo sapiens
ccaatcgctagcaaactccctgcctagcaaggcccagcctggggcagaaatggctgcaagtggccgaggtctctgcaaggctgtggccgcctctcccttcccggcgtggagacgagataacacggaagccaggggaggtctgaagcctgagtatgatgcggtggtgataggagcaggacacaacggactggtggctgcagcgtacctgcagagactgggggtgaacaccgccgtcttcgagaggcgccatgtgatcgggggtgcagctgtcactgaggagatcatcccagggtttaagttctcccgtgcgtcctacctgctcagcctgctgaggccgcagatttacactgatctggagctgaagaaacatgggctgaggcttcatcttcgaaacccctactccttcacccccatgctggaagagggtgcaggcagcaaggtgcccaggtgccttctgctgggcacagacatggcagaaaaccagaagcagatcgcccagttctcccagaaggatgcccaggtctttcccaaatatgaggagttcatgcatcgcttggcattagccattgaccctctgctggatgcggcccccgtggacatggcggccttccagcatggctccttgctgcaaaggatgaggtcgctctccaccctcaagcccctgctgaaggcaggccgcatcctgggagcccagcttccccgatattatgaggtcctcacagctcccattaccaaggtgctggatcagtggttcgagtctgagcctttaaaagccactctagccacagatgcagtgattggagccatgacaagtccccacactccggggagtgggtatgtgctgctgcaccatgtgatggggggcctggagggaatgcagggggcctggggctacgtccaggggggcatgggtgccctctctgatgcgatcgcaagctcagccaccacacatggagcaagcatcttcactgaaaagacagtggcgaaggtgcaggtgaacagtgaaggctgtgttcaaggagttgtgctggaagatggcacagaggtgagaagcaaaatggtgctgtccaacacatcaccgcagatcaccttcctgaagctgacgccacaggagtggcttcctgaggagttcctggagagaatctctcagctggacacccggtcgcctgtcaccaagatcaatgtggccgtagacaggctgcccagcttcctggcggcccccaatgctcccaggggccagccgctgccccatcaccaatgctccatccacctgaactgtgaagacaccctcctccttcatcaggcctttgaagatgccatggatggcctgccttcccacaggcctgtgattgagctctgcatcccttcctcgctggaccccaccctggctccccctggctgccatgtagtctccctcttcactcagtacacgccctatacgctggctggaggcaaggcctgggacgagcaggagagagacgcttatgcagacagagcacagctgactgcacgaaccaaaggagaagcatgagccagagagacaaggaaggctttcaaaggaagggatggtcaagctgggtttccaaggatgactaggagctggccaggcagcaaagggcattccaagcaagagaaacagcttgatcaggccaggcgtgggggctcatgcctgtaattccagcacttcgggaggccgaggcaggcggatcacccgagtgtttgattgcatcgaggtctatgcccctggcttcaaggactctgtggttggcagagacatcctcacaccaccagatttggagagaatcttcgggcttcctggagggaacatattccactgcgccatgtccctggaccagctctacttcgcccgccccgtgcccctgcattctggctaccgctgccctctccagggcctgtatctctgtggaagtggggctcatcctggaggaggtgtgatgggagctgctgggcgaaatgcagcacatgtggcctttagggacctcaagagcatgtgaccctgaaccagctctgacccaggaagaagactccacccctgaattccaagtgctccattggatcagcttcccaggaagttcagcttcgggttagtacataaggccaccacaatgctcaagaaattattttagaaaaaacgtacgagttacatttagtgcaagttgaccttatgcccatgcctccatacatggactggttctgttttattaaaactaatatttcatacagattaaaaagat

SEQ ID NO: 358410 - DNA, 691 bp, Homo sapiens
ccaatcgctagcaaactccctgcctagcaaggcccagcctggggcagaaatggctgcaagtggccgaggtctctgcaaggctgtggccgcctctcccttcccggcgtggagacgagataacacggaagccaggggaggtctgaagcctgagtatgatgcggtggtgataggagcaggacacaacggactggtggctgcagcgtacctgcagagactgggggtgaacaccgccgtcttcgagaggcgccatgtgatcgggggtgcagctgtcactgaggagatcatcccagggtttaagttctcccgtgcgtcctacctgctcagcctgctgaggccgcagatttacactgatctggagctgaaggtagggcccccccgccggcccgattgcacggagggaggaggcagttccatcttcccaacctgtgtggggggtccctgttctgtgcccgaggtgatgcccgcccctgagggctccctcttccacccaagtcttgtgtatcccacgtggtctccctgctgcattcccacagatgggttttgtctcgtccatgtagtgtcttgaaaagtgggaaatttcatccaaaaatcagacttcttttgaagaatgagctttttcaccctcaggcccacgtgggacacctatctgaagccttgggcgcctgagcttacagctgccttgggacatgag

SEQ ID NO: 358411 - DNA, 2665 bp, Homo sapiens
  misc_feature (930)..(930): n is a, c, g, or t
  misc_feature (984)..(984): n is a, c, g, or t
  misc_feature (1567)..(1567): n is a, c, g, or t
  misc_feature (2084)..(2084): n is a, c, g, or t
gaaatgatgcctccatttactgaaaagaggaagaggtggtgggggtggagcagattttagaggctaatcaggcattggggtttgaacaggggatgtttgagatccctggtggacatccgagttcagcgagaacattgcagctgagggacgcagggagaaggggcatttcccgtggccttgaaggagactcatatttggagatcagagggagaacatgctccaggtagaaaaggtgtggcaggcaaaggtggtggggtgggaagcaggtcacagctctgctggggctcggggcagccctagcagctctgtcttccattggtctgctctggaaaaggcagtcaggccactaaagcctggctgaaatctggctgcttgggcgcctgctgtcttaggcctggcccctttccacactcccactgtctgtgtggaccttcgagacatttgcatttgggagctgtggttagagcacagcgtgtgatgaaggcaggcaaggacaggccatgcattcgggggtctggggtcaggcgagctcctcacaggtgctctggaccacgctagcagccgctaagcccgtgcaggtggacaaccactgtggctgtagagcgacaatcgcccagaattggtgtcatctcagcgcctccactgtgtcccaagtcatctcggatgccctaccctccgccctgctgctctttagacctgccgtctcctccctgcccgcacaggcctgtgattgagctctgcatcccttcctcgctggaccccaccctggctccccctggctgccatgtagtctccctcttcactcagtacacgccctatacgctggctggaggcaaggcctgggacgagcaggagagagacgcttatgcagacagaggtaaagacagctgcacgttctgcctccagagccacagccgggcatgcgacccnactgggcctgctcctcctcactgccccattcaggattgacaactgcaggtgccnttccaaagggaggaaatagtcaagggaacctcaagtcaacatagttgactgcaggggtcaggaactgggctaagaaagtcaagaagacacagttcctgccctccagttgctcacagtctagcaagggatggaggagactaattaagaaaccttttattacagcacagctgactgcacgaaccaaaggagaagcatgagccagagagacaaggaaggctttcaaaggaagggatggtcaagctgggtttccaaggatgactaggagctggccaggcagcaaagggcattccaagcaagagaaacagcttgatcaggccaggcgtgggggctcatgcctgtaattccagcacttcgggaggccgaggcaggcggatcacccgaggtcaggagttcaagaccagcctgaccaacatggtgaaaccccgtagctactaaaaacataaaaaaattagcagggtgtggtggcacatgcctgtaatcttagctgctcaggaggctgaggcaggagaatcgtttgaacccagaggcggaggttgcagtgagctgagattgcgccactgcactccagcctgggtgacagagngagactccgtctcaaaaaaaaaaaaaaaaacagcttgagaaaagtgaagaggtgaaaaaagctgcatatgcaaaaggagatcagcagcttcgtgtttaaggttggggtagggaagtggggaaaactggggactggactggcctacccatgcatctttgggatgaattaatcatttgcttgtggactgatttttgtttttcacctattgaggtataatttgcatatgataaaataagcccatttctgtgtgtaatttaatgactgttagtaaatttgccaagttgtacacccatagtgcctcctcttcttcctaataccatctcatttctctgtttttggcaccccagtgtttgattgcatcgaggtctatgcccctggcttcaaggactctgtggttggcagagacatcctcacaccaccagatttggagagaatcttcgggcttcctggaggggtatgtataagcctagggggtctctcaccatagccttccctctgcaccctcacttcctggctntgacctctctgctttatcttgtccctccatactcagctttcatcaggaagggaggacagtggcagggaccccggctgagagagggcagagaagcggtcaaaccgagggaatgggggatccctagtgggggctcagaaacacaggcaggacagcccccactgagaaggtcaccaggattgtggccctctgccttgacaactatgctggctctgccatctgactttcttgagagagagcacccccttctcaaggcagcagcacatcctcagacttgtcaatttatcaaaaactagagattggagacagggagaccagataggaggccaggttcaatcgcctcattgcagctactgagcacttgaaagatcagagaccaccctaggcaacgtagtgagaccccatctctacaaaaacaaaaaccccgccaggtgtggtggtgcgtacctgtggttccagctacccaggaagctgaaacaggatgatcgcttgagcccaggagtttgagactgcagtgagctgtgatgcgtcattacacttcagcctgggcaacagaatgagaccctatctctagaaagaaaatt

SEQ ID NO: 358412 - DNA, 1755 bp, Homo sapiens
ccaatcgctagcaaactccctgcctagcaaggcccagcctggggcagaaatggctgcaagtggccgaggtctctgcaaggctgtggccgcctctcccttcccggcgtggagacgagataacacggaagccaggggaggtctgaagcctgagtatgatgcggtggtgataggagcaggacacaacggactggtggctgcagcgtacctgcagagactgggggtgaacaccgccgtcttcgagaggcgccatgtgatcgggggtgcagctgtcactgaggagatcatcccagggtttaagttctcccgtgcgtcctacctgctcagcctgctgaggccgcagatttacactgatctggagctgaagaaacatgggctgaggcttcatcttcgaaacccctactccttcacccccatgctggaagagggtgcaggcagcaaggtgcccaggtgccttctgctgggcacagacatggcagaaaaccagaagcagatcgcccagttctcccagaaggatgcccaggtctttcccaaatatgaggagttcatgcatcgcttggcattagccattgaccctctgctggatgcggcccccgtggacatggcggccttccagcatggctccttgctgcaaaggatgaggtcgctctccaccctcaagcccctgctgaaggcaggccgcatcctgggagcccagcttccccgatattatgaggtcctcacagctcccattaccaaggtgctggatcagtggttcgagtctgagcctttaaaagccactctagccacagatgcagtgattggagccatgacaagtccccacactccggggagtgggtatgtgctgctgcaccatgtgatggggggcctggagggaatgcagggggcctggggctacgtccaggggggcatgggtgccctctctgatgcgatcgcaagctcagccaccacacatggagcaagcatcttcactgaaaagacagtggcgaaggtgcaggtgaacagtgaaggctgtgttcaaggagttgtgctggaagatggcacagaggtgagaagcaaaatggtgctgtccaacacatcaccgcagatcaccttcctgaagctgacgccacaggagtggcttcctgaggagttcctggagagaatctctcagctggacacccggtcgcctgtcaccaagatcaatgcatggagcaagcatcttcactgaaaagacagtggcgaaggtgcaggtgaacagtgaaggctgtgttcaaggactctgtggttggcagagacatcctcacaccaccagatttggagagaatcttcgggcttcctggagggaacatattccactgcgccatgtccctggaccagctctacttcgcccgccccgtgcccctgcattctggctaccgctgccctctccagggcctgtatctctgtggaagtggggctcatcctggaggaggtgtgatgggagctgctgggcgaaatgcagcacatgtggcctttagggacctcaagagcatgtgaccctgaaccagctctgacccaggaagaagactccacccctgaattccaagtgctccattggatcagcttcccaggaagttcagcttcgggttagtacataaggccaccacaatgctcaagaaattattttagaaaaaacgtacgagttacatttagtgcaagttgaccttatgcccatgcctccatacatggactggttctgttttattaaaactaatatttcatacagattaaaaagat

SEQ ID NO: 358413 - DNA, 563 bp, Homo sapiens
ccaatcgctagcaaactccctgcctagcaaggcccagcctggggcagaaatggctgcaagtggccgaggtctctgcaaggctgtggccgcctctcccttcccggcgtggagacgagataacacggaagccaggggaggtctgaagcctgagtatgatgcggtggtgataggagcaggacacaacggactggtggctgcagcgtacctgcagagactgggggtgaacaccgccgtcttcgagaggcgccatgtgatcgggggtgcagctgtcactgaggagatcatcccagggtttaagttctcccgtgcgtcctacctgctcagcctgctgaggccgcagatttacactgatctggagctgaaggtcagcccacctgctggctggtgaggactcggaggaaacaggagggggtcgcatgtggagcactaggccgccgctgcagcggttcccaaaatggcggcttggagagacgcgcacagattctggaggcagcggatgggatgtcaaggatgaccaggagagagactaaggatgcctcctgggtatgagtgagtttactaca

SEQ ID NO: 358414 - DNA, 897 bp, Homo sapiens
agagaatcgcttgagcgtgggaggcggaggttgcagtgagccgagactgtgccactgcactgtagcctgggccacagagcgaggctccatctcaaaacaaaacaaacaaaaaacaagagaaacgagaggttacaaattggttgatgctgacctgaagtatttcaatataaaaaaatgtcgcctatctaaaaaaaatggagtgtaaagtcctttgggggggcccccatgattttggttaacttttttaagaaacctgggcccccggctcccccaaaggctggagcaactgccttttcagtcgggcaggcatctcctggttccgctcgtctgtgccgtcctgtctgcctctcaccaccagagccctgctcagggtcttgcaggcagtggaattgtgagcctggatagtgggcggcagtgccgttgtaaagcctcctgactgggtttggaatgctgtttgggtaaacacttttcctttctcaggaaatgctgtctatgatttcttcattggccgtgaattaaaccctcgaattggtacttttgatctcaaatacttttgtgaattgcgccccggattgattggatgggtatgtctggttttttttcttctaaatttcaattcaataggtctaattaactgctagaaagaaatgtagaccattcaaaaataagcagtgggtggtatatttttagggataattatggctttccataaatctatcaaaatactttcttgtaagtattttccagaggtttaagatgccctgttacaggttatgacaaattaaataacttttctttgctttatttttattatatcagtttatatttatgtaggaaagtgatagtgtggatgaattaatgtaagaaaaaatgcattttcctcctttttaaatttta

SEQ ID NO: 358415 - DNA, 886 bp, Homo sapiens
gaaatgatagctgtgtccttctcagtgcattgggtccaggggcccatggtgctgagatgtcttattcctggtggcgggtaggagttacggtggcgtctgccaggtgtctcagctgtgaagctcactcatgcctttgtagtgctaaggtctctggggaggtgctttgaggctatatactttccccttttgtttcaggtggttattaacttggtgatgcttttggctgaaatgaaaatacaggaccgcgctgttccatccttggccatgattttagttaatagtttccagcttctctatgtggtggatgctctctggaatgaggtaattaattttaagagccgaggccttggagtcagatggctttgagtgggtgagtgacctgtcagagcctcggcttcttgcacacaaagtgaggggagcatggcctgcctccaaggctgcttgagaggaggacgaggccatccatgcgaagctgacgagggagcactgacaggtgggaagtttctaggcatttgggagtgcttcagtgtttatcagctgttcttgtgtttaaaagtaatattctaaatatttaagattggtggatcttggttttgtttttgtgggtggtggtaattatggtatcacatgaaaatggatggattattactaaattagaatggtgtttcttggactgtcaagagtcacctagtttttaaataatgggggagatgttttattgttaatgttttaaaatacaaagactagctctaattagatgaatgtaaaatcagaaatcaagatgcattgaggaaaccagttgaaataaggctaagtttccatcttgtgtcttttttcatacattgattagtctttctactagttgaagactggtaaatgttttgtt

SEQ ID NO: 358416 - DNA, 3823 bp, Homo sapiens
gaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatca

SEQ ID NO: 358417 - DNA, 3883 bp, Homo sapiens
gagcagaaaaaaaaaagcttaggatccgtaacagattcggagtcaacaatgacatgactcagcattttggggttcaattattaccaggcttgtaggttgcaggtcaagttgtgtttcggtgtgtaacgcataaaacttctgttccacgctccgcggtgttggggattttctactgcatctcgacagcatctcgggtaacaaccgagcccctcctcgcagcgttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatca

SEQ ID NO: 358418 - DNA, 3045 bp, Homo sapiens
agagaatcgcttgagcgtgggaggcggaggttgcagtgagccgagactgtgccactgcactgtagcctgggccacagagcgaggctccatctcaaaacaaaacaaacaaaaaacaagagaaacgagaggttacaaattggttgatgctgacctgaagtatttcaatataaaaaaatgtcgcctatctaaaaaaaatggagtgtaaagtcctttgggggggcccccatgattttggttaacttttttaagaaacctgggcccccggctcccccaaaggctggagcaactgccttttcagtcgggcaggcatctcctggttccgctcgtctgtgccgtcctgtctgcctctcaccaccagagccctgctcagggtcttgcaggcagtggaattgtgagcctggatagtgggcggcagtgccgttgtaaagcctcctgactgggtttggaatgctgtttgggtaaacacttttcctttctcaggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatca

SEQ ID NO: 358419 - DNA, 3769 bp, Homo sapiens
gaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttagtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatca

SEQ ID NO: 358420 - DNA, 3854 bp, Homo sapiens
gaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatcaaaaaaaacgagaacaaccaccccccaaaaag

SEQ ID NO: 358421 - DNA, 3898 bp, Homo sapiens
gaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacacttggtcataagattgggtcgacctgttaattgggaaatttctatgaagtctcaagggaaataccagttgcacctctggccccaaaaaacaaacacaccacggggggccgtaacaacaaccaaaaaggggtacacaaggcggacaccaggaacacgcagcacccccg

SEQ ID NO: 358422 - DNA, 3011 bp, Homo sapiens
gaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttagtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatca

SEQ ID NO: 358423 - DNA, 1780 bp, Homo sapiens
gaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatgtaagaccatcatacttcacgggaaagatcctcgaggtcc

SEQ ID NO: 358424 - DNA, 1675 bp, Homo sapiens
gaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtatgtctggttttttttcttctaaatttcaattcaataggtctaattaactgctagaaagaaatgtagaccattcaaaaataagcagtgggtggtatatttttagggataattatggctttccataaatctatcaaaatactttcttgtaagtattttccagaggtttaagatgccctgttacaggttatgacaaattaaataacttttctttgctttatttttattatatcagtttatatttatgtaggaaagtgatagtgtggatgaattaatgtaagaaaaaatgcattttcctcctttttaaatttta

SEQ ID NO: 358425 - DNA, 1409 bp, Homo sapiens
gaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggtacgtttatggtaattctgttttgttttaataagatgaggtctcactatattgtccaggcgggtctccaatttctgggatcaagtgatcctcttgccgcagcctcctgagtcgctgggaccacaggcctgtgccatgctgcccagccttagagtagtttaaaggttaaaggctgttgttggtcataattcccaaaacttagttcatgaagccatttctcttgtgctgtctgtataacacttgcttattaggaggaacttaaaaaaaaatctgattgagatttcttgtgtaacttttcaaaccaaatagaaaagaataggctattttgcaaagtagccgactctcagtggaggttgctatggaaaaaaaattcactcttagtatgtgtcatttcagat

SEQ ID NO: 358426 - DNA, 797 bp, Homo sapiens
gcagggggatcttgggaagctgggggagctgggggaactgggggagcagggggatccaggggagctggtggaggtggaggagctggcccgtgcctgctgcctgtttggtggcccagcctgtggtggaagacagcagtttttcttctttgctgggggaagaagggcgagaaatgaagagatgtgtattaactatgaggacagatgttttgattgtgatggattgttagaatggattcatcagtctttgagtagcttctaatttagatacgaccttctgccactttccagtgggattttacagacttgtttaattattctcatcattattagagaaaatgaagtaccttgtggttccatttttagagaatttgggggaaagcaggaaaaaatacattgtagtgataataaaaatatctaatactgtgtactattattatccacaggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagtt

SEQ ID NO: 358427 - DNA, 4231 bp, Homo sapiens
ggccgctgggggaggaagcccgaggccggcgcagcggccgggccggggaccctgggcgcggggcctggcgcggcggccttcccctcctctcctcgcctcctcgtctcctcccctcctcgccttttctggcccagtcgggtggtcggggcggcggcgggcgaggctggagctcgcccgagccgggcccgctgcggaaatggagctgggggttttaaactgcggacgtttccctccatgttggcggcgcggcgcggctgtggagcggcggcggcagggagggttcgtgggcgcctttgtcctgccccaccgcagcctggctcccggcccctccgagcgcccgtctgacagatgagcaggcggccccgcggtcctgcagtaggaggctgacagggcgcggcggcctggcgggacggggaagggtctgcggccgaggtgggcttagattcgcgctgcttgtcactggctttgagggtcgtggtcgtcgcggtttggtgattctccaggcacactgcatggctgctcgctcctatgcgttgaattccttcgcccggacagtctcaaaaatcgggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatca

SEQ ID NO: 358428 - DNA, 3773 bp, Homo sapiens
gaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatca

SEQ ID NO: 358429 - DNA, 2125 bp, Homo sapiens
gtctcgacatcattaaaaatgtacttttatttttatatagatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatca

SEQ ID NO: 358430 - DNA, 3065 bp, Homo sapiens
gaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatca

SEQ ID NO: 358431 - DNA, 2071 bp, Homo sapiens
gaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaacgtgagtattaattttagtctcagtttaatttattaaatattatgtactgaggcttttatgccctgctgtctacatacttgaaacatgccattttgaatggccagcattagctcagtttgaagccatttatcatgagtaataaaaaatctgcattttgcaaagagaatggatggttcgtacttgggttctcagtagtacttgaaacagattattttaaaccatcttgcttttaaatttaataaatttaagttgttttaattcgttttggtaaccatacgtcttttctcttgagtgcctgctttttctggtaggcatcttataaagtaagaagatttgtcttgccttcatagagctcacattctaacaggagaaataagacattcctgccttgctgtgaggtgtgtgagtgagcac

SEQ ID NO: 358432 - DNA, 1142 bp, Homo sapiens
gaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttactgatgggagcaagacccagtcttgctcccatcagtcccatcaaccacgtcacttgtgtaaccctcgttggactgctgttttgataacctacagaggtcatgtatagta

SEQ ID NO: 358433 - DNA, 1575 bp, Homo sapiens
gaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggtgagcagtgatgaattgcatgttggatgaatgcgtcccagagccctccagcagccatttccagatttgaatagattgctttttttctaacttcatttttgggaaatgaagagaagtaagaaaaaatgaaaagatgaagaaaaacgttaaagagatatgaatttaaaggaagaaaatatttttgttttaccttcatactttcttactcatttcttttttttgcagttgcttgatgacagtaagacgtttagtaaacttacaggcattttgacttatgacaaatattatttctttgtccaaaatagtaaacactcttt

SEQ ID NO: 358434 - DNA, 312 bp, Homo sapiens
ttataggaagaaaatgtataacatcattaaacaattaaattctataaactgtattaattcttggagttatgaaattttaacaatattatctaaaccttgggacaaatcatctctacatctgatttagttatttgtttgtttatcatatatctttcctggtacaatgtaagcaccataaaagcagagatcatatagatcttgcttactgttgactcccagggcctaaaagacaacacatagaataggtatttaagaatattttgatgaacaagtaaattggtgaataaagcagtaaactaactatatgggagt

SEQ ID NO: 358435 - DNA, 270 bp, Homo sapiens
ctgaaacagcaatcttttgaccataactactggggggggaaagcagcccttgctgtaatcatcgttcataaaaactctggaatttacttgcacaaagagctcattgagagctgacagttctgctacagccattcctttctttccaaggaggaagcatcagaaaaatgagtggcccagcttgtgccatttctgcaaagggagtgttcaaaagtcggtgccttgggtatcagcaggcttggcttcccaaatgggtggaggtagcagtgtggt

SEQ ID NO: 358436 - DNA, 640 bp, Homo sapiens
gccagcctgggtgacagagcaagactccgtctcaaaaataaaaaaataaaaaaaaataagctgggcatagcagtgggtgcctgtgatcccagctactcgagaggctgaggcaggagaatcccttgaacccgggaggcggaggttgcagtgagccgagatcttgccactgccctccagcccgggcaatagagtgagattctgtctcaaaaataataataataaaaataaataaataaatggagaactccactggttaagagcgaagggaaggattacttctggatttaggagacgaactgctggacaggtcactcgacctgtagagttttgtgcattttggattttgctgattgtataaccccatggtgaggtttaacatgttcctctggaacaggaattaaaagaaattaaagaacgtgtaagcagaaactcagttgtatgtaagaaaacccaatttcccctgagaaaaagaaggagctgaagtcctttaaaaattaactgcctgtttttctgtggctagtgagccttatctctcctcctttcccaggcactgtgaagatcctgtttccctagctgtgcagctgcaaggtcactagacagataaactcaagttgtaaaaaatgtttttccttgaaaagta

SEQ ID NO: 358437 - DNA, 1098 bp, Homo sapiens
  misc_feature (1)..(5): n is a, c, g, or t
nnnnngactctactagaaattgagttttaatatgaaattgaaaataatggtaaataaatgatgctcctagtgagaggcagtaattctttaatccaataatattaaggccaaagaaaggagagcactgaagcttatctggtgctggtcagaactcttgtaaaatgcaagttacaaaaacaataagatattatctcacacttagttaaaaaaaagtatatatataaaatctgtgatgaatcaacccatttcctgggcaagaataccaaagaaactacctcgcagatttataagggaacatgtatgagtatgctctcatggtgtttttatagtggcagggaaccagaaacaatctggttgtttatcaaacacatggtcttttatgattttctgcttcttttcacattgttccctttgccctcttttcttcctggaaagttgagatcactcttcaggagcctactgaaaaaccacctgcatgtgggggaacataagagattcctgtagagaaggctgaataaatgtcagtcagaagaaagcaaagagagacaggagtgacgtcacagtgaattcagcaccacggacagctcacagcactccagcccgggcgacagagtgagactgcgcctgaaaaaaaaaagttattggaatgttttgatatcagaatttctggggaacatttggatttccagaatctctttcacatcagctgtaatgtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358438 - DNA, 434 bp, Homo sapiens
agcggccgcctactactactaaattcgcggccgcgtcgacgaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358439 - DNA, 452 bp, Homo sapiens
  misc_feature (31)..(31): n is a, c, g, or t
ttttcgacatgatgcccacggacttgcgtcnaccaggtcttctgaaagacagctgacaagagacatggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358440 - DNA, 754 bp, Homo sapiens
  misc_feature (585)..(585): n is a, c, g, or t
agcggccgcctactactactaaattcgcggccgcgtcgacgaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgtttgcgcccttggcccccnttttttttttattcgggcaagtttttacttgcgccccgaatttgggctctttggccaattccccttttggggggggttaaaaaaaaagggggcggttttaaacgggtgaggggaaaaacccggggtcccaaataaatggttggaaatacccctttgcaggggggaaaaa

SEQ ID NO: 358441 - DNA, 425 bp, Homo sapiens
aagtaccacctgcagatgggtactagtacccacctgcacgtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcaggtgggaagtacccacctgcagtaagggtaccgagc

SEQ ID NO: 358442 - DNA, 437 bp, Homo sapiens
gcgtagaccgatagctgtggtgttgaccgtagctagtagggttgaccgtagctagtagggtagaccgtggtcagtgggttgacgtggcttgagaaagcttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358443 - DNA, 523 bp, Homo sapiens
gacttatgttaaccactgatgccatgatgggaactccccatatgcaatatatttttaactagaatgttattaaatatgtacattaatcaagaagtgaaataactgaaaagctaacatggtgggctaggaattgtcaacagcagttttaacacagggagttatatgccactccagcctgtagtggcatataactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttatatgccactccagtgcgcttcctgtagagtggagctgtgggcgttcgggcttggcccgtggtcgtcgttcg

SEQ ID NO: 358444 - DNA, 337 bp, Homo sapiens
gcggccgcctactactactactaaattcgcggccgcgtcgacggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358445 - DNA, 422 bp, Homo sapiens
ctgttttatccatgtgttgaagaagccgacctggtgtgcacacgagtatatttatgttgttgatcctctcagcttctgttctataagccaccttggtgagtttggaatgacacagttctcttgacgacctgccatagcaaatcagcaatatctcaggatttgggatcttaactaggaactgtatgccattcttgctgcagcaagaatggcatatcaggatagttcagacggtttctatttcctgagcgtctgagatgttagtattagttagttttgttgtgagtgttaggaaaagggcatacaggactaggaagcagataaggaaaatgattatgagggcgtgatcatgaaaggtgataagctcttctatgatagggaagtagcgtcttgtagacctacttgcgctgatatgccatcatgct

SEQ ID NO: 358446 - DNA, 531 bp, Homo sapiens
cagttcccaacaagtaaacttgactttccttctgataacggatctggatgttgtaaacttaatctttgtacaacaccatgaggacatatggattggttgttgttttttgagagatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358447 - DNA, 598 bp, Homo sapiens
tcacgtctgataccaccgctactactatgtcctatcataacattccatacatacttaaaaccaagcaaagggtggagttccatctttaaaaactaaacaggcattttggacaacacattcttggcaatagaacctgggtggtatagggtggtatagggtggtataggagctataccaccgatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358448 - DNA, 946 bp, Homo sapiens
tgcagcctgcagtccgacttagaggaccccgactacatacttccgatgtctcttgtcagctgtctttcagaagacctggtaagtgggactgtctgggttggccccgcactttgggcttctcttggggagggtcagggaagtggagcagccttcctgagagaggagagagaaagctcagggaggtctggagcaaagatactcctggaggtggggagtgaggcagggataaggaaggagagtatcctccagcaccttccagtgggtaagggcacattgtctcctaggctggacttttcttgagcagagggtggggtggtaaggaaagtctacgggccccgtgtgtgtgcacatgtctctgtgtgaatggacccttccccttcccacacgtgtatccctatcatcccacccttcccaccagagccatagccatctgctggtttggttatttggagagtgcaggccaggacaaggccatcgcttggggcatgaatcctctgcgtactgccctggccagatgcaaattccctgccatgggattccccagaaggttctgtttttcaggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358449 - DNA, 424 bp, Homo sapiens
aagtaccacctgcagatgggtactagtacccacctgcacgtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358450 - DNA, 646 bp, Homo sapiens
tgcagcctgcagtccgacttagaggaccccgactacatacttccgatgtctcttgtcagctgtctttcagaagacctggtaagtgggactgtctgggttggccccgcactttgggcttctcttggggagggtcagggaagtggagcagccttcctgagagaggagagagaaagctcagggaggtctggagcaaagatactcctggaggtggggagtgaggcagggataaggaaggagagtatcctccagcaccttccagtggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358451 - DNA, 465 bp, Homo sapiens
  misc_feature (74)..(75): n is a, c, g, or t
gcgtcgacaacatgatgcccacggacttgccccacctgaaaaacagaaccttcaggtcttctgaaagacagctnncaagagtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358452 - DNA, 467 bp, Homo sapiens
taaaataaaatacacaaaaaataaataaataaaaataaaataaaataaaataaaaacaaaaaataaaaaaatagccaccggtgtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358453 - DNA, 757 bp, Homo sapiens
  misc_feature (588)..(588): n is a, c, g, or t
tgcagcctgcagtccgacttagaggaccccgactacatacttccgatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgtttgcgcccttggcccccnttttttttttattcgggcaagtttttacttgcgccccgaatttgggctctttggccaattccccttttggggggggttaaaaaaaaagggggcggttttaaacgggtgaggggaaaaacccggggtcccaaataaatggttggaaatacccctttgcaggggggaaaaa

SEQ ID NO: 358454 - DNA, 756 bp, Homo sapiens
  misc_feature (488)..(488): n is a, c, g, or t
  misc_feature (490)..(490): n is a, c, g, or t
  misc_feature (492)..(492): n is a, c, g, or t
  misc_feature (502)..(502): n is a, c, g, or t
  misc_feature (506)..(506): n is a, c, g, or t
  misc_feature (508)..(508): n is a, c, g, or t
  misc_feature (519)..(519): n is a, c, g, or t
tgcagcctgcagtccgacttagaggaccccgactacatacttccgatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaaaaaaaaaaaaaaaaaaaaaaaaaanananaaaaaaaaanaaananaaaaaaaaaanaaataaaaaaataaaataaaaaaaaaaccatgtcggccgccttggcccagctgattttagactcgggcaagtttaggcatgcggcccgaaattggggctaacttgcccaattccgcctaatggggagcgtattcaaattaactgcccgtggtttaacaagtcggaattgaaaaacccttgctgtacccaacttaatcgccttggagaaaatcccttttgccagttggcgtaaatacc

SEQ ID NO: 358455 - DNA, 760 bp, Homo sapiens
tgcagcctgcagtccgacttagaggaccccgactacatacttccgatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcattgaacgatgacaaatcgagtagaactcccgaattgaagcccccattcgtataataattacatcacaagacgtcttgctctcatgagctgtccccacattaggcttaacctctgtggcgcttcccggccatgtaaaccaaaccactttgaccgttaaacgaccgggcctatattagggtcaatgggtcagaattccccttaggaaccacagatacatgcccattggcctagaattaacacccctatttgcaggtggggtataagggaaaggccccccccggtcgccttcccacaccagccactctta

SEQ ID NO: 358456 - DNA, 732 bp, Homo sapiens
  misc_feature (464)..(464): n is a, c, g, or t
  misc_feature (466)..(466): n is a, c, g, or t
  misc_feature (468)..(468): n is a, c, g, or t
  misc_feature (478)..(478): n is a, c, g, or t
  misc_feature (482)..(482): n is a, c, g, or t
  misc_feature (484)..(484): n is a, c, g, or t
  misc_feature (495)..(495): n is a, c, g, or t
tgcagcctgcagtccgacttagaggaccccgactacatacttccgatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaanananaaaaaaaaanaaananaaaaaaaaaanaaataaaaaaataaaataaaaaaaaaaccatgtcggccgccttggcccagctgattttagactcgggcaagtttaggcatgcggcccgaaattggggctaacttgcccaattccgcctaatggggagcgtattcaaattaactgcccgtggtttaacaagtcggaattgaaaaacccttgctgtacccaacttaatcgccttggagaaaatcccttttgccagttggcgtaaatacc

SEQ ID NO: 358457 - DNA, 469 bp, Homo sapiens
  misc_feature (454)..(454): n is a, c, g, or t
tgcagcctgcagtccgacttagaggaccccgactacatacttccgatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatctgtcantcatatggaccgccg

SEQ ID NO: 358458 - DNA, 525 bp, Homo sapiens
gacttatgttaaccactgatgccatgatgggaactccccatatgcaatatatttttaactagaatgttattaaatatgtacattaatcaagaagtgaaataactgaaaagctaacatggtgggctaggaattgtcaacagcagttttaacacagggagttatatgccactccagcctgtagtggcatataactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358459 - DNA, 374 bp, Homo sapiens
  misc_feature (29)..(29): n is a, c, g, or t
tcgcacccaatgtatggatatgagttggngaaagccttaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358460 - DNA, 2862 bp, Homo sapiens
  misc_feature (1)..(5): n is a, c, g, or t
nnnnngactctactagaaattgagttttaatatgaaattgaaaataatggtaaataaatgatgctcctagtgagaggcagtaattctttaatccaataatattaaggccaaagaaaggagagcactgaagcttatctggtgctggtcagaactcttgtaaaatgcaagttacaaaaacaataagatattatctcacacttagttaaaaaaaagtatatatataaaatctgtgatgaatcaacccatttcctgggcaagaataccaaagaaactacctcgcagatttataagggaacatgtatgagtatgctctcatggtgtttttatagtggcagggaaccagaaacaatctggttgtttatcaaacacatggtcttttatgattttctgcttcttttcacattgttccctttgccctcttttcttcctggaaagttgagatcactcttcaggagcctactgaaaaaccacctgcatgtgggggaacataagagattcctgtagagaaggctgaataaatgtcagtcagaagaaagcaaagagagacaggagtgacgtcacagtgaattcagcaccacggacagctcacagcactccagcccgggcgacagagtgagactgcgcctgaaaaaaaaaagttattggaatgttttgatatcagaatttctggggaacatttggatttccagaatctctttcacatcagctgtaatgtgagtgtgggcatagagctgtcaagtattctttctctttagtaccaatataatgtccagtagctattaattattccaaatcaagtaaattcttgctctagtatgtgttagaacaaaggttgaattctgatcaatatgacactaatacctgtgcccttaggccttgctctaaaatgtcctccttccaatgcagaatgacacattgccccaccctattccttgacactctttcgaaggaatattggatgaaatcaaatcaattttctatctggtgactggagctctgggctgtggttgcggagatggtctggtcccctctcctcttcatatccatctgcttctgttctataagccaccttggtgagtttggaatgacacagttctcttgacgacctgccatagcaaatcagcaatatctcaggatttgggatcttaactaggaactgtatgccacacatgtgtccctgccctgtgatcacctctctgggatgacatgggtgtgtaaacagaatatccgaatagatgtgatgagtcctgcattgacataagcatggagagtgtgaaatagtctcaggaacattagacaaggctcccttgagaaggtgatttctaaaacctagacaagaagatgaagaagtatttgtccacacactccatcctaatttttatgtgccattgccaattggacggaatattatcaggtgaaataagaactggaaaaataaagggagggcaggcccacattaggagtggccaattgccttctggactgtagcgatggattgaaggtccagcaaccccaccccagggagaccctctcttcttttgggagatcagtacgtgagtcctgagggaactgttcagtcatttgccttatcctttctggcctgcttccagactctggggtccagattctggggtcctcccctaagctgcacaacctgcctccaggactggaagtttttggattttacactgctgtttacataaagtagtattgactagaatttgcacaaatacattttatattgaaaaatgatatagagtacttattatgagctggaatccagtactactatgtgctgggtaaccaggagatccgaggtaacaatgttttccctccatgattccaagtctggctggaaagacattaggggaatctgaagtaatgtagccactatggtaagagtggggtcatggtgagggaggcacaaatgaagcagagatcatttctttggggtgaagggatggtggttcaccctctgaatgtctaagagacactgacattaaagctcagccttgaaatgtaatgttaatgagacagaagaagtattaaaagacatttctggtagaggcagtagtttaaaagattggtattgagacatgaaatactgagatatattgatggggggtatgttgcgcattcggggaataacagcagcaaggtgaataggagggattcagagagtgctgcacagagaggaagtcaggcacccacacttttgggaccctggcatgacggttctaagcagtgaccagcagtcccggtggaggagagaggaggacaacaggggaagatggttctgggctggagatctgcagggaaggtatggcccaaggaaagtgggcaacagagctaagagaggaaagagagcaattctggggtggatgatggagggcaggctgcatagagaaggcagcagggggctgggaggagaaaatgaaagcccagggactgtaggtctccgtgagttccaagaacaggtggaatgagaatgagaaagggagagaaggaaagagaagaaaactaatggtcagacatggggatttagaggtgaaaatggcagatcagtcctgaaggctgacgaggtgcagaatatgttcaggaaggaatgttcctgataaggagaggagatgctggtctgtgaatagaggtgtgagtgtggagtggagcagtcattccaaagaacaaatagcccatcttacacactgctgctggtaggatggaaagagaatttttgagatgtttgcctgattcctccaagaagaatgtttgcctgattgagaggttagctggagactgaccagagtagtaagagtgatagggacacatgattagcctcaaggaagaatactaagagcggctgca

SEQ ID NO: 358461 - DNA, 461 bp, Homo sapiens
tgcagcctgcagtccgacttagaggaccccgactacatacttccgatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttatatgccactccagtgcgcttcctgtagagtggagctgtgggcgttcgggcttggcccgtggtcgtcgttcg

SEQ ID NO: 358462 - DNA, 437 bp, Homo sapiens
tgcagcctgcagtccgacttagaggaccccgactacatacttccgatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttaggtcaacccacaagccacggtcaacccacaagccacggtcaacccac

SEQ ID NO: 358463 - DNA, 518 bp, Homo sapiens
tgcagcctgcagtccgacttagaggaccccgactacatacttccgatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttaccactaggtagcagtaccactaggtagcagtaccactaggtagcagtaccactaggtagcagtaccactaggtagcagtaccactaggtagcagtaccactaggtagcagtaccactaggtagcagta

SEQ ID NO: 358464 - DNA, 1097 bp, Homo sapiens
tgcagcctgcagtccgacttagaggaccccgactacatacttccgatgtctcttgtcagctgtctttcagaagacctggtaagtgggactgtctgggttggccccgcactttgggcttctcttggggagggtcagggaagtggagcagccttcctgagagaggagagagaaagctcagggaggtctggagcaaagatactcctggaggtggggagtgaggcagggataaggaaggagagtatcctccagcaccttccagtgggtaagggcacattgtctcctaggctggacttttcttgagcagagggtggggtggtaaggaaagtctacgggccccgtgtgtgtgcacatgtctctgtgtgaatggacccttccccttcccacacgtgtatccctatcatcccacccttcccaccagagccatagccatctgctggtttggttatttggagagtgcaggccaggacaaggccatcgcttggggcatgaatcctctgcgtactgccctggccagatgcaaattccctgccatgggattccccagaaggttctgtttttcaggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcagggtgaggaggggctgggtgtggcgggggctctctgcctggtcctggggctgccctgggccagcggtcctccctgccacccttcatagatggctatgcctcggctctctctgagatctttaaactctggcttcttcctcctcaatcttgacagaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358465 - DNA, 645 bp, Homo sapiens
gcgtcgactttgaaccagacgtctgcaccctttttcctgatatactgagaacactcggtctctagcaatttcttcaggtcatccctgtagacggcatggaaattcccctttatcagggagtacttgtggtagacgtcgatgatagagttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcattgaacgatgacaaatcgagtagaactcccgaattgaagcccccattcgtataataattacatcacaagacgtcttgctctcatgagctgtccccacattaggcttaacctctgtggcgcttcccggccatgtaaaccaaaccactttgaccgttaaacgaccgggcctatattagggtcaatgggtcagaattccccttaggaaccacagatacatgcccattggcctagaattaacacccctatttgcaggtggggtataagggaaaggccccccccggtcgccttcccacaccagccactctta

SEQ ID NO: 358466 - DNA, 771 bp, Homo sapiens
tgcagcctgcagtccgacttagaggaccccgactacatacttccgatgtctcttgtcagctgtctttcagaagacctggtaagtgggactgtctgggttggccccgcactttgggcttctcttggggagggtcagggaagtggagcagccttcctgagagaggagagagaaagctcagggaggtctggagcaaagatactcctggaggtggggagtgaggcagggataaggaaggagagtatcctccagcaccttccagtgggtaagggcacattgtctcctaggctggacttttcttgagcagagggtggggtggtaaggaaagtctacgggccccgtgtgtgtgcacatgtctctgtgtgaatggacccttccccttcccacacgtgtatccctatcatcccacccttcccaccagagccatagccatctgctggtttggttatttggagagtgcaggccaggacaaggccatcgcttggggcatgaatcctctgcgtactgccctggccagatgcaaattccctgccatgggattccccagaaggttctgtttttcaggtggggcaagtccgtgggcatcatgttgaccgagctggagaaagccttgaactctatcatcgacgtctaccacaagtactccctgataaaggggaatttccatgctctactcctgagctaactaaaggcattggaataaccctctgtactcggtacactcgagtccatgtacaaatgccacaaataaattgaatgtttaaagccaaaaaa

SEQ ID NO: 358467 - DNA, 391 bp, Homo sapiens
  misc_feature (376)..(376): n is a, c, g, or t
agcggccgcctactactactaaattcgcggccgcgtcgacgaagacctgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatctgtcantcatatggaccgccg

SEQ ID NO: 358468 - DNA, 483 bp, Homo sapiens
gcctgaagctgtgggcagctggccaagcctaaccgctataaaaaggagctgcctctcagccctgcatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358469 - DNA, 762 bp, Homo sapiens
  misc_feature (74)..(75): n is a, c, g, or t
gcgtcgacaacatgatgcccacggacttgccccacctgaaaaacagaaccttcaggtcttctgaaagacagctnncaagagtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcattgaacgatgacaaatcgagtagaactcccgaattgaagcccccattcgtataataattacatcacaagacgtcttgctctcatgagctgtccccacattaggcttaacctctgtggcgcttcccggccatgtaaaccaaaccactttgaccgttaaacgaccgggcctatattagggtcaatgggtcagaattccccttaggaaccacagatacatgcccattggcctagaattaacacccctatttgcaggtggggtataagggaaaggccccccccggtcgccttcccacaccagccactctta

SEQ ID NO: 358470 - DNA, 813 bp, Homo sapiens
gcggccgcctactactactactaaattcgcggccgcgtcgacgggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaggggcgagggcgcgcgagcgcagccacatcctaccccgcagcgacgacaggagaacgccgacaaaaaaacacaggagagagagagcgagaccacagagaggagcggaactagaaaaacaaggagaaggaggggggggctcagaaaccacgcaaacggagagagggagaccaccgcacgagcgaaagggtcgtgcagcacatttagtgggcggaaagatacacaagctcttcagtggaggggtagagaacattagaggtaaaagcgcagcggtgagataggcagtatgctacgaaggaagagatagaagcaaaataatgagaggcaagtaagtgaggagctaaaaaaaggcaaggcaaagg

SEQ ID NO: 358471 - DNA, 962 bp, Homo sapiens
tgcagcctgcagtccgacttagaggaccccgactacatacttccgatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaggggcgagggcgcgcgagcgcagccacatcctaccccgcagcgacgacaggagaacgccgacaaaaaaacacaggagagagagagcgagaccacagagaggagcggaactagaaaaacaaggagaaggaggggggggctcagaaaccacgcaaacggagagagggagaccaccgcacgagcgaaagggtcgtgcagcacatttagtgggcggaaagatacacaagctcttcagtggaggggtagagaacattagaggtaaaagcgcagcggtgagataggcagtatgctacgaaggaagagatagaagcaaaataatgagaggcaagtaagtgaggagctaaaaaaaggcaaggcaaagg

SEQ ID NO: 358472 - DNA, 753 bp, Homo sapiens
  misc_feature (550)..(550): n is a, c, g, or t
  misc_feature (554)..(554): n is a, c, g, or t
  misc_feature (562)..(562): n is a, c, g, or t
  misc_feature (569)..(569): n is a, c, g, or t
  misc_feature (571)..(571): n is a, c, g, or t
  misc_feature (573)..(573): n is a, c, g, or t
  misc_feature (575)..(575): n is a, c, g, or t
  misc_feature (581)..(581): n is a, c, g, or t
  misc_feature (587)..(587): n is a, c, g, or t
  misc_feature (598)..(598): n is a, c, g, or t
  misc_feature (600)..(600): n is a, c, g, or t
  misc_feature (604)..(604): n is a, c, g, or t
  misc_feature (614)..(614): n is a, c, g, or t
  misc_feature (616)..(616): n is a, c, g, or t
  misc_feature (619)..(619): n is a, c, g, or t
  misc_feature (625)..(625): n is a, c, g, or t
  misc_feature (645)..(645): n is a, c, g, or t
  misc_feature (651)..(651): n is a, c, g, or t
  misc_feature (657)..(657): n is a, c, g, or t
  misc_feature (659)..(659): n is a, c, g, or t
  misc_feature (663)..(663): n is a, c, g, or t
tgcagcctgcagtccgacttagaggaccccgactacatacttccgatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccnttgngggccgcntggcccnancnanttttanattggncaaggttattntngcgnccgaatttgngnttnattggnccattccccctatggggggnggattnacattnantggnccggggtttacaacggccgggactggaaaacccctggcggtacccaaattatatcggctttggaaaaaacccctttttgggagctggggt

SEQ ID NO: 358473 - DNA, 752 bp, Homo sapiens
  misc_feature (549)..(549): n is a, c, g, or t
  misc_feature (553)..(553): n is a, c, g, or t
  misc_feature (561)..(561): n is a, c, g, or t
  misc_feature (568)..(568): n is a, c, g, or t
  misc_feature (570)..(570): n is a, c, g, or t
  misc_feature (572)..(572): n is a, c, g, or t
  misc_feature (574)..(574): n is a, c, g, or t
  misc_feature (580)..(580): n is a, c, g, or t
  misc_feature (586)..(586): n is a, c, g, or t
  misc_feature (597)..(597): n is a, c, g, or t
  misc_feature (599)..(599): n is a, c, g, or t
  misc_feature (603)..(603): n is a, c, g, or t
  misc_feature (613)..(613): n is a, c, g, or t
  misc_feature (615)..(615): n is a, c, g, or t
  misc_feature (618)..(618): n is a, c, g, or t
  misc_feature (624)..(624): n is a, c, g, or t
  misc_feature (644)..(644): n is a, c, g, or t
  misc_feature (650)..(650): n is a, c, g, or t
  misc_feature (656)..(656): n is a, c, g, or t
  misc_feature (658)..(658): n is a, c, g, or t
  misc_feature (662)..(662): n is a, c, g, or t
tgcagcctgcagtccgacttagaggaccccgactacatacttccgatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccnttgngggccgcntggcccnancnanttttanattggncaaggttattntngcgnccgaatttgngnttnattggnccattccccctatggggggnggattnacattnantggnccggggtttacaacggccgggactggaaaacccctggcggtacccaaattatatcggctttggaaaaaacccctttttgggagctggggt

SEQ ID NO: 358474 - DNA, 467 bp, Homo sapiens
agcggccgcctactactactaaattcgcggccgcgtcgacgaagacctgatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358475 - DNA, 463 bp, Homo sapiens
tgcagcctgcagtccgacttagaggaccccgactacatacttccgatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaa

SEQ ID NO: 358476 - DNA, 637 bp, Homo sapiens
gttcttattgaaactgactgcgggaacccatgtgctttactgtgactatatactgcatctctcacacactatctgaaaatgtgtcactatttgtttagcacttatccacaggaaatactgttaggtattatgtaggacacaggcattttttaaaacaccaaaccccacagtctctgtcttctgagagcttacagtacagtcagcgagatgaggcaggtatgaagattccagtgcatgcaatgcagtgtgttataaaagtcccatgactaccagagggaatacagatgtaaaacttaggaggaaaagaaatcactctggatgagccagtcaggtaagtttacatggaataagtagaaatgggtcttgaaagatgggtacgagtttgataggtgaatttgaagatacagatagcaccttctgtgtagaggaaacaagaaaagacaaaagcagtaaagcaagaagaaatgtgggaggttagtcaagtttttttttctagaattctcaagttgtagagccagaattaagagtagcttaagtgttaagctaaaaaaaattgaattttattttggtaggcaactaaaactagaaatagtttatcatgcgcctctgggtgagggtatgctacttttaaaagcag

SEQ ID NO: 358477 - DNA, 5172 bp, Homo sapiens
gcgtcgtttgcggcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgatttttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaattagcctttgtttggttatattgagaaaagggtagtttcctgcataaatggcaaagaacaatcatttattggtttattttgtctctactaaacacattagtcatttatcatttaaataccggacttcattagaaaccgttgtaacactttttctccctcctgccataaaaatacagtaagtaatttgcttaaaaaaaacaacacaacactaggaacaagtgttctggtttcttctcactgaactaaagacatttctcagtgatttcagtttgtaaatcagtaagac

SEQ ID NO: 358478 - DNA, 4528 bp, Homo sapiens
gttcttattgaaactgactgcgggaacccatgtgctttactgtgactatatactgcatctctcacacactatctgaaaatgtgtcactatttgtttagcacttatccacaggaaatactgttaggtattatgtaggacacaggcattttttaaaacaccaaaccccacagtctctgtcttctgagagcttacagtacagtcagcgagatgaggcaggtatgaagattccagtgcatgcaatgcagtgtgttataaaagtcccatgactaccagagggaatacagatgtaaaacttaggaggaaaagaaatcactctggatgagccagtcaggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgatttttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaatta

SEQ ID NO: 358479 - DNA, 2556 bp, Homo sapiens
gtctcgagtgttttttttttctctgtcactaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgatttttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaatta

SEQ ID NO: 358480 - DNA, 2108 bp, Homo sapiens
tcttcagacaattgctattatcaatcatagcaaaaaataaaaaataaatacagctgggatgagagaggacattctagatgcatcagaacttacataaagattgacagaagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgatttttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaatta

SEQ ID NO: 358481 - DNA, 1460 bp, Homo sapiens
tgtctgctctagagatcccccgaagccactgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgatttttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaatta

SEQ ID NO: 358482 - DNA, 2332 bp, Homo sapiens
gcgtcgtttgcggcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtatttttaaaaatatgatactaatggggatattgtagatgagaccaacttcctgttgttagtcatttagttcaagttaacatctaagaacatttattctgtttttatttacatagttaatctctatttgtggagtagaaaagaaatagaatcttaagacctatgtaaattcttttaatattgtatgaaagatctattttgggtaaaagctttgattcctctctatctaataaaagtttttagaatactgtgatttttatgagctgagaaggcttaaaaaaagtagcacacatgtcactagctaatcttgtatagcagcctttttttattttatgaaaattaaataccattgaaaatgtcagaaaaaaaataaaaagttctctttcatgtgttacagagaggcatagagttaaagcattgatttggtagctagttcttttttttttttgagatggagtcttgctctgtcgcccaggctggagtgcagtggcgccatctcagctcacagcaagct

SEQ ID NO: 358483 - DNA, 355 bp, Homo sapiens
acattttgtctgtatttgtttttcctatagtaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaaggtgagtttagccatgccagaagagtagaaatacaggagcaggtaagccaggggttcttttttattttggtaatttcatgtttgtgttttacttgcctacagtatgaaggagaaaattctcatcatacttctcttaatt

SEQ ID NO: 358484 - DNA, 480 bp, Homo sapiens
ataatgttctttaaaaaatgtttattaattctgtgtaattttttttttctttagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggttagtttgagccctgtctgctttctaagatttggttattgaccattttccaatttcctattctttcattattaatgccttaattcacccatgaataattttttatcaattgtatactcagtcctgttgtgagtctatagaggacctagcaataagatgtataagtggaagatcttctttccttagatttctttaatataatacaagacacagtaactaataacaccagacagtgtagagtaaaacacaaaagtgtctt

SEQ ID NO: 358485 - DNA, 4889 bp, Homo sapiens
gcgtcgtttgcggcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgatttttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaatta

SEQ ID NO: 358486 - DNA, 4676 bp, Homo sapiens
gcgtcgtttgcggcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgatttttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaatta

SEQ ID NO: 358487 - DNA, 4817 bp, Homo sapiens
gcgtcgtttgcggcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgatttttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaatta

SEQ ID NO: 358488 - DNA, 4174 bp, Homo sapiens
gcgtcgtttgcggcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaaggtgagcctaacatcaatcttggcctttactaacctcaaaatgcttcagatgctagaaacagggtttgtgctaagcttaggcactcattagagtgatgagagctgccagggagcagtgatcagtcagtcctcatgaagcaaaacccagggtttgttttgttttttgccttttttgagggggagggggtggaattttagggtgggaaacagggtaagggatttggatttctttttattccctctcctatttgtacattttgctgtaaacctgaaatttgtgtttatcccatttgtaacaattttccacatttgttagggaaagaaattttggattccttaccaaaggcctgtttctgggacaggcagtgtcctcaggactctggctaatgggagaagttgacatttttgacattgcagtgcaatagtcatattagcacagatgtatgtggcaacagccacctcattctaagaaggggaaggaagcttgagtcaggccttaatgttgaaaagtcagggagctgttgaggtatggaagggcactcagcaggaagcaggttaaggggaagaaaacagtgtccttgaggcagacagtgatccaaagcttaattacgggcatcatgctatgttagcgagtggaactggattgtgaaggcccttacataatgagatttttattgataaaggttgcttagaggctgggcgttgtggctcacacctgtaatcccaacactttgggaggccacagtgggcagatcacctgaggtcaggagttcaagaccagcctagtcaacagggtgaaacctcat

SEQ ID NO: 358489 - DNA, 2110 bp, Homo sapiens
  misc_feature (2051)..(2051): n is a, c, g, or t
gcgtcgtttgcggcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggaactatttacattttaatatagatggcaccactggtacagaagcatctggtctagcttacttacagntttgggggaattggctatttaaaatgaacattctgagccaggccgggttggcttacgcc

SEQ ID NO: 358490 - DNA, 1979 bp, Homo sapiens
tccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgca

SEQ ID NO: 358491 - DNA, 525 bp, Homo sapiens
acccagagacagtgaaaaatagatgaactaagagaacaagaatcggatggtcttagtaactagattctggacatatgcatcattgatgttgcagtgtggttccccggaagcacactgcaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcagtgtgcttccggggtaccgagctct

SEQ ID NO: 358492 - DNA, 929 bp, Homo sapiens
ccccgcccggtactttttccggaggcggcccaagcggcagttggctgcagaggaccccacgtttaggattttatagggaagaggaggaatttttcgtagaaatccccgctctgcgtgctcgtggtggaggctgctggcaatggcctacgtcgtcataccgggcttccttgccctgtccggggtaaacaatccttctgtgtatttacccccttttttctttaaagattggagatcgggttaagttcttagagagtctgatgcgagtggctggaaggatagacaagagaattctattctataaatatgcattgggaatttaaaatgctaaacgccttatttgcaattctgttggatattctagagactggtatatttttatctgacatggataattttgaggggacgttatattttggggaagtttacaaagtgattctttctgcctttctaacttgggcgaaatatatcgactcataccaccctttcaaaaaagatagctttctctactaggtgtttgggttcgaagacagtttaaaaattacctcgtgttcagtacctaagattgctgttttgcctcgagggttttccaagtagaagtgggtagttttcatgtactttgagaattctgaggtttttaacccccccctttttttttaaatataaatcttttctattttgaagtaatgagactttaaaggatcttgtttttgtaatcacttgatttcaaaggatacttcttacagcaattataaagtaatagtcaaaatgctaattagacattttcagtcatagctgctttaatgttgaaacagaatttttttctttagcagagactgtatcgtagagttgaaacgctaaatattcttttgtctggcatcagatctctgaactgctctgacattctcctgaaaaacccctagtgccctttt

SEQ ID NO: 358493 - DNA, 384 bp, Homo sapiens
aattcgagctcgggtacacggaatgtgtggtgttatggtgacaagtagagctggtcatgtcgacagccccctcttacctcgtcgcgtctcagcagatgtccatggggtcgtattgggagtgacttttgtaccagttggcttggctgattttggaaagagtggaagaacccccttcaccttgtgagttttgttcatctgtgttgcatgtgtttgcacagtgtacattgactgaaacgtgaagaaacagcccttgggcttttgagtctcggttttctttcttggcgctcatgctctcagaataataatacgtgtggtgcaggcccggtgcaccaggcaagtgagggctgtgctggcatggtttctttaggaggaaggcctgttgca

SEQ ID NO: 358494 - DNA, 738 bp, Homo sapiens
gcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcgggggtggctcgggagcggcccggaggagccggcggcggcccgaggagcgagggaccgaaccgggagccatgccgcgctgagggggggccgcacagccgccgccaccgccaccgccgccgggtggggtgggaggggcgggatacgccgccgccgccgcctccagggtgggcgcctttcgccgtggacgccgaccgtccgggacgagggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggttcatagtggcgtcatgcacgcagactcctgcaagttcccctaagttcttagaggactgctttgcctttgatctgagagttgcaaagttccataaagaatggcccttgttggataagcacaaagtcaagagacagcgattggacagaattgtgagg

SEQ ID NO: 358495 - DNA, 6136 bp, Homo sapiens
  misc_feature (4)..(4): n is a, c, g, or t
gaanccgattaatcctccagttggttgtccctgccgtctcggaagggttagcacacagccaggtctgtttttgatgtatgtaattgaagatttataaagaaaagcttctcctctgcctcatccacagtcattttttttccaatgccagttcccagcaggcatataaatattggtcgttctcagagctgggatgctgctgggtggtacgagggcccctgggagaacgccgagtccctgcggcctctggggaggagaagctccctgacgtatggcacagcagaggggacttggtttgagccaaaccaccgaccacaggacgctgccctgcccgtggccgccgagccctacctgtaccgggaggccgtttataactcagtggctgcaagaaaggggtctactcctgacttcaccttctacgacagcagacaggcagtgatgtctggtcgcagccccctgctgccacgggagtactacagtgatccgtctggagctgctagggtacccaaagagcctcccctctatcgggacccaggagtcagccggccggtccccagctacggagtgcttggcagcagaacgtcatgggatccaatgcaaggccggtcacctgccctgcaggacgccggtcacctgtaccgggatcctggaggtaaaatgatccctcaggggcggcagacacagagcagggctgcatctcccgggcggtatggacgggagcagcccgacaccaggtatggggcggaggtgcctgcctaccccctcagccaggtcttcagcgacatcagcgaaagacccattgaccctgcccctgccagacaggtggccccgacgtgcctggttgtggaccccagttcagctgctgcccccgaaggcagcacaggggtggccccaggggccctgaatcgtggctacgggcctgcccgggaaagcatcccatccaagatggcttacgagacttacgaagctgacctgtccaccttccagggtcctggtggcaagaggaccgtgctccctgagttcctggcctttctgcgggcggaggggctggcagaggccacgctgggagccctactgcagcagggctttgactccccggccgtcctggctaccctggaggacgcggatatcaagtctgtcgcacccaacctgggccaggcccgtgttctgagccgcctggccaatagctgcaggaccgaaatgcagctgcggaggcaggaccgggggggcccgctgccccgggcgcggtccagcagcttcagccaccgaagcgaactgctccatggtgacttggcttctctgggcgctgcggctcctctgcagacagcatccccccgagctggagacccggctcgccgtccctccagcgcaccatctcagcacctcctggagacggcagccacctattctgcccctggcgtgggcacccatgccccacacttcccctccaactccgggtacagctctcccaccccttgcgccctgacagcgcgtctgagccccacgcaccccctgcaggcaggggtggccttgactaacccgggcccctcaaacccccttcacccaggccccagaacagcttactccacggcatacacggtgcccatggagctgctaaagagggagcgcaacgtggccgcctctccgctgcccagccctcacggcagcccccaggtcttgcggaagccaggtgcacccctggggccatccaccctgccgccggccagccagagcctccacacgcctcactcaccgtacgagaaggtggcccggcgcacaggggcacccatcatcgtgtccaccatgcttgcaccagaaccaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcgggggga

SEQ ID NO: 358496 - DNA, 4703 bp, Homo sapiens
tccctgtgtgcgtgtgtcattttaaggtggctcgggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcgggggga

SEQ ID NO: 358497 - DNA, 4920 bp, Homo sapiens
aaaattgttatccgccatccagatcgacgacgtgcatacgatggttatgaaccaatgaaggtgtattcccttaaaaagacggacagcccatcgtgtgaactatagagtttgtggacagatttatattgccttagaccagaacactgcggaagaggaaatccatcatggaaacccgagagtgacaggacccttgctatggtgacaagtagagctggtcatgtcgacagccccctcttacctcgtcgcgtctcagcagatgtccatggggtcgtattgggagtgacttttgtaccagttggcttggctgattttggaaagagtggaagaacccccttcaccttggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcgggggga

SEQ ID NO: 358498 - DNA, 4799 bp, Homo sapiens
gcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcgggggga

SEQ ID NO: 358499 - DNA, 4842 bp, Homo sapiens
gcctcactattgctagtcgaggctggctttaatcggccgagggtcctcttgcgttgtatttaaggtggctcgggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagatggagaaaacaaaggattcagattgaaggactgctcagacaccctccgaagaggtggccctgcctgcgctcctcctggctgcagagtaccccaccagcgcggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcgggggga

SEQ ID NO: 358500 - DNA, 4788 bp, Homo sapiens
atcttgtgacaatggcctctcaggctccccagacgcatcagcggctctggattcccaccttgcgcccagcgtggttttcctgtgtggctaccatttaacgaacagcttggatttcttataatcaggcactctctccgataaccatcctgccagcacccctgaaagtgaagttggggtgttcctcactgtgtgtgggcgaccgcctggggcatgagaccaggacttccaggccccacagggttgtgcgctcagacctcaagtaggggccagaagagtgtactgaaacagaaggaatcttgtggaatttggcagttgtaccattttcttagcagaaaacaggagcccaggtgggagccatgtgtgtcgggttcctcgtcaggtgacggtgctgttgcggatctcgcggatgagctgagggggtatccagctttgtgctgcacgcttcctgtccactcatacaggtcgtgggctggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcgggggga

SEQ ID NO: 358501 - DNA, 4395 bp, Homo sapiens
tccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcgggggga

SEQ ID NO: 358502 - DNA, 3932 bp, Homo sapiens
  misc_feature (4)..(4): n is a, c, g, or t
gaanccgattaatcctccagttggttgtccctgccgtctcggaagggttagcacacagccaggtctgtttttgatgtatgtaattgaagatttataaagaaaagcttctcctctgcctcatccacagtcattttttttccaatgccagttcccagcaggcatataaatattggtcgttctcagagctgggatgctgctgggtggtacgagggcccctgggagaacgccgagtccctgcggcctctggggaggagaagctccctgacgtatggcacagcagaggggacttggtttgagccaaaccaccgaccacaggacgctgccctgcccgtggccgccgagccctacctgtaccgggaggccgtttataactcagtggctgcaagaaaggggtctactcctgacttcaccttctacgacagcagacaggcagtgatgtctggtcgcagccccctgctgccacgggagtactacagtgatccgtctggagctgctagggtacccaaagagcctcccctctatcgggacccaggagtcagccggccggtccccagctacggagtgcttggcagcagaacgtcatgggatccaatgcaaggccggtcacctgccctgcaggacgccggtcacctgtaccgggatcctggaggtaaaatgatccctcaggggcggcagacacagagcagggctgcatctcccgggcggtatggacgggagcagcccgacaccaggtatggggcggaggtgcctgcctaccccctcagccaggtcttcagcgacatcagcgaaagacccattgaccctgcccctgccagacaggtggccccgacgtgcctggttgtggaccccagttcagctgctgcccccgaaggcagcacaggggtggccccaggggccctgaatcgtggctacgggcctgcccgggaaagcatcccatccaagatggcttacgagacttacgaagctgacctgtccaccttccagggtcctggtggcaagaggaccgtgctccctgagttcctggcctttctgcgggcggaggggctggcagaggccacgctgggagccctactgcagcagggctttgactccccggccgtcctggctaccctggaggacgcggatatcaagtctgtcgcacccaacctgggccaggcccgtgttctgagccgcctggccaatagctgcaggaccgaaatgcagctgcggaggcaggaccgggggggcccgctgccccgggcgcggtccagcagcttcagccaccgaagcgaactgctccatggtgacttggcttctctgggcgctgcggctcctctgcagacagcatccccccgagctggagacccggctcgccgtccctccagcgcaccatctcagcacctcctggagacggcagccacctattctgcccctggcgtgggcacccatgccccacacttcccctccaactccgggtacagctctcccaccccttgcgccctgacagcgcgtctgagccccacgcaccccctgcaggcaggggtggccttgactaacccgggcccctcaaacccccttcacccaggccccagaacagcttactccacggcatacacggtgcccatggagctgctaaagagggagcgcaacgtggccgcctctccgctgcccagccctcacggcagcccccaggtcttgcggaagccaggtgcacccctggggccatccaccctgccgccggccagccagagcctccacacgcctcactcaccgtacgagaaggtggcccggcgcacaggggcacccatcatcgtgtccaccatgcttgcaccagaaccaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattgtgaaacttaatactttttttttttttttgcctgtggtagacacctgcacgcataggattgaagacagtacaggtctgctgtacagagaagcgcctctcacatctgaactgcatactgagcgggcaagtcggttgtaagttcagtaaaaccctctgat

SEQ ID NO: 358503 - DNA, 4104 bp, Homo sapiens
tccctgtgtgcgtgtgtcattttaaggtggctcgggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcgggggga

SEQ ID NO: 358504 - DNA, 3192 bp, Homo sapiens
acccagagacagtgaaaaatagatgaactaagagaacaagaatcggatggtcttagtaactagattctggacatatgcatcattgatgttgcagtgtggttccccggaagcacactgcaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcgggggga

SEQ ID NO: 358505 - DNA, 2198 bp, Homo sapiens
gcctcactattgctagtcgaggctggctttaatcggccgagggtcctcttgcgttgtatttaaggtggctcgggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccc

SEQ ID NO: 358506 - DNA, 1957 bp, Homo sapiens
tccctgtgtgcgtgtgtcattttaaggtggctcgggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacaggtgagaaaaggaactgactttgtctcagcttgtgagcaccacggccccggggccagggagagaagcccaaacttggcggaagcttaacctcccgcagatgctaagtcagggtcagaacaatcagccttctcagcaggaactgtgtacaccgcccccatttcttccaatgcctaatttcatggaacaaacagaagctcctattttaaaagggggtgtgttcggtcagatgtgattgaccacaggtgctaggaactgcctttcattctaaagccatcttaaaaccagaaggcttcccagtcacgtgtggtggcgcacacctgcagtctcagctgctagggaggctgaggtgggagaggtgcttgaagctgggaggtggagattgcagtgagccgagatcacccactgcactccagcctaggccacagagtgagacaatgctgctaccccccgaccccaccccaccaccaaaaa

SEQ ID NO: 358507 - DNA, 863 bp, Homo sapiens
tccctgtgtgcgtgtgtcattttaaggtggctcgggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaagtcgccacagcgagatcgactgaacggcgcacaccgtgcgcacacacccggggggcacttgagataagcggcatgacgtcggacggcccagggacatgcacgggaaaagaaagtagcgacaatcgctgagaggcacctggccaacgagtaggcattcatgtgaccgcgcaagacaagaaggacaacgcagaaaagtcggaacggaagaaaacgggaagcactaaagaacaggaagcgcccaggaggaggaagcacaggccgaagtggaattggatgtaacacaaaagacgaccaaaaatctcaagcaccacttaccgacgaaacagaggacacaggagaacccattgggagacgcaaaaagaattaccaagaagggccacccattgcaaaacaaggctgcaatcaggcaagaaagggagaagacagcagcaaaaagggggcggcaaagggaagcaaagaaaggcgggaaaaaaatag

SEQ ID NO: 358508 - DNA, 1324 bp, Homo sapiens
aaaattgttatccgccatccagatcgacgacgtgcatacgatggttatgaaccaatgaaggtgtattcccttaaaaagacggacagcccatcgtgtgaactatagagtttgtggacagatttatattgccttagaccagaacactgcggaagaggaaatccatcatggaaacccgagagtgacaggacccttgctatggtgacaagtagagctggtcatgtcgacagccccctcttacctcgtcgcgtctcagcagatgtccatggggtcgtattgggagtgacttttgtaccagttggcttggctgattttggaaagagtggaagaacccccttcaccttggtttcatcaccttaaatggttttgaaccaatgaaggtgtattcccttaaaaagacggacagcccatcgtgtgaactatagagtttgtggacagatttatattgatcgactgcaatatatagagtgggcactgtttacatgtctgggtatcatgctgagagaatatgatgaaaagatcaatgctgtagtaaaaacagcatttgttctagtagtgctctcgagtttttattcttctttatcattatgtgggttatgacaggccttggttctgatcgacgttctagacttcgaatggttatgtaacagactgttataaaagtgcgtatttaagttatttgagaagttatatgaagataattgtgtcagctatctggggagtatgttaatgtgaacctgagagttataagagtactcttatatctacctggaatactccttctggtcgtaacacagttgtatcttgtgtaaggctacatctctattaccttcaggtttcttctaacgtctggaagctacttcaggttagaatgtgctaatactgcatctgatcaatcacgctgctagcgtctacaacctacttcagtgttaacacttgtctaatacagtactgcttcagagacacaaccctgcattgtcacaagctggcacgtgtctgactcgtgtaaaccgatgcctaagcacattgggactttttgcgttacagtatatggtcgcgtccttgcaacgaaggtgaaacgacacaggaccaggatggtaacggacgtctatcacccacaacggcatgcagcaccacgcgctcgtgctcctatgacagcatctcacaaattcaccaccacctctacgaactcactaaacacaaccgaggaccctggcacagcggacaccgagcgacgaccctcacaaaccccggagaaaaggggcacacaaggaggccactaccagcagaaagcaataacaacagcgaacaagaaaaccgcagacgc

SEQ ID NO: 358509 - DNA, 3720 bp, Homo sapiens
  misc_feature (4)..(4): n is a, c, g, or t
gaanccgattaatcctccagttggttgtccctgccgtctcggaagggttagcacacagccaggtctgtttttgatgtatgtaattgaagatttataaagaaaagcttctcctctgcctcatccacagtcattttttttccaatgccagttcccagcaggcatataaatattggtcgttctcagagctgggatgctgctgggtggtacgagggcccctgggagaacgccgagtccctgcggcctctggggaggagaagctccctgacgtatggcacagcagaggggacttggtttgagccaaaccaccgaccacaggacgctgccctgcccgtggccgccgagccctacctgtaccgggaggccgtttataactcagtggctgcaagaaaggggtctactcctgacttcaccttctacgacagcagacaggcagtgatgtctggtcgcagccccctgctgccacgggagtactacagtgatccgtctggagctgctagggtacccaaagagcctcccctctatcgggacccaggagtcagccggccggtccccagctacggagtgcttggcagcagaacgtcatgggatccaatgcaaggccggtcacctgccctgcaggacgccggtcacctgtaccgggatcctggaggtaaaatgatccctcaggggcggcagacacagagcagggctgcatctcccgggcggtatggacgggagcagcccgacaccaggtatggggcggaggtgcctgcctaccccctcagccaggtcttcagcgacatcagcgaaagacccattgaccctgcccctgccagacaggtggccccgacgtgcctggttgtggaccccagttcagctgctgcccccgaaggcagcacaggggtggccccaggggccctgaatcgtggctacgggcctgcccgggaaagcatcccatccaagatggcttacgagacttacgaagctgacctgtccaccttccagggtcctggtggcaagaggaccgtgctccctgagttcctggcctttctgcgggcggaggggctggcagaggccacgctgggagccctactgcagcagggctttgactccccggccgtcctggctaccctggaggacgcggatatcaagtctgtcgcacccaacctgggccaggcccgtgttctgagccgcctggccaatagctgcaggaccgaaatgcagctgcggaggcaggaccgggggggcccgctgccccgggcgcggtccagcagcttcagccaccgaagcgaactgctccatggtgacttggcttctctgggcgctgcggctcctctgcagacagcatccccccgagctggagacccggctcgccgtccctccagcgcaccatctcagcacctcctggagacggcagccacctattctgcccctggcgtgggcacccatgccccacacttcccctccaactccgggtacagctctcccaccccttgcgccctgacagcgcgtctgagccccacgcaccccctgcaggcaggggtggccttgactaacccgggcccctcaaacccccttcacccaggccccagaacagcttactccacggcatacacggtgcccatggagctgctaaagagggagcgcaacgtggccgcctctccgctgcccagccctcacggcagcccccaggtcttgcggaagccaggtgcacccctggggccatccaccctgccgccggccagccagagcctccacacgcctcactcaccgtacgagaaggtggcccggcgcacaggggcacccatcatcgtgtccaccatgcttgcaccagaaccaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgca

SEQ ID NO: 358510 - DNA, 2310 bp, Homo sapiens
  misc_feature (4)..(4): n is a, c, g, or t
gaanccgattaatcctccagttggttgtccctgccgtctcggaagggttagcacacagccaggtctgtttttgatgtatgtaattgaagatttataaagaaaagcttctcctctgcctcatccacagtcattttttttccaatgccagttcccagcaggcatataaatattggtcgttctcagagctgggatgctgctgggtggtacgagggcccctgggagaacgccgagtccctgcggcctctggggaggagaagctccctgacgtatggcacagcagaggggacttggtttgagccaaaccaccgaccacaggacgctgccctgcccgtggccgccgagccctacctgtaccgggaggccgtttataactcagtggctgcaagaaaggggtctactcctgacttcaccttctacgacagcagacaggcagtgatgtctggtcgcagccccctgctgccacgggagtactacagtgatccgtctggagctgctagggtacccaaagagcctcccctctatcgggacccaggagtcagccggccggtccccagctacggagtgcttggcagcagaacgtcatgggatccaatgcaaggccggtcacctgccctgcaggacgccggtcacctgtaccgggatcctggaggtaaaatgatccctcaggggcggcagacacagagcagggctgcatctcccgggcggtatggacgggagcagcccgacaccaggtatggggcggaggtgcctgcctaccccctcagccaggtcttcagcgacatcagcgaaagacccattgaccctgcccctgccagacaggtggccccgacgtgcctggttgtggaccccagttcagctgctgcccccgaaggcagcacaggggtggccccaggggccctgaatcgtggctacgggcctgcccgggaaagcatcccatccaagatggcttacgagacttacgaagctgacctgtccaccttccagggtcctggtggcaagaggaccgtgctccctgagttcctggcctttctgcgggcggaggggctggcagaggccacgctgggagccctactgcagcagggctttgactccccggccgtcctggctaccctggaggacgcggatatcaagtctgtcgcacccaacctgggccaggcccgtgttctgagccgcctggccaatagctgcaggaccgaaatgcagctgcggaggcaggaccgggggggcccgctgccccgggcgcggtccagcagcttcagccaccgaagcgaactgctccatggtgacttggcttctctgggcgctgcggctcctctgcagacagcatccccccgagctggagacccggctcgccgtccctccagcgcaccatctcagcacctcctggagacggcagccacctattctgcccctggcgtgggcacccatgccccacacttcccctccaactccgggtacagctctcccaccccttgcgccctgacagcgcgtctgagccccacgcaccccctgcaggcaggggtggccttgactaacccgggcccctcaaacccccttcacccaggccccagaacagcttactccacggcatacacggtgcccatggagctgctaaagagggagcgcaacgtggccgcctctccgctgcccagccctcacggcagcccccaggtcttgcggaagccaggtgcacccctggggccatccaccctgccgccggccagccagagcctccacacgcctcactcaccgtacgagaaggtggcccggcgcacaggggcacccatcatcgtgtccaccatgcttgcaccagaaccaagtgcggctcccaggatgactgaagctggtcacttggtagtcccactgactccgctctgtgaggccgactcgaccgtgaccagtgacagagccaaaagatctcacactgatgagagaaagttcctcacataccatgagatagcgatcatagacggcatctctccttgacacttttcttgtccaacagcggcaacgccctcagcagacgaatctatgatcacacagcaaaacagaggttacataacccgtgtacctccctcactagggacgccttagctgaaatagtaaccatcaactgcacatcactcccgtctgacttagaggtaccggaaccatgggtaccaagggttcctacaagatcgcgtagaaagcccgatcgagtatccaggaactgggcactgggtcgcattccaccttgcgacgctgacccgtctacgcggacttgcgcgctgaaccccacactcctaattagccggccatcgcaagcgcatg

SEQ ID NO: 358511 - DNA, 2429 bp, Homo sapiens
gcctcactattgctagtcgaggctggctttaatcggccgagggtcctcttgcgttgtatttaaggtggctcgggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgca

SEQ ID NO: 358512 - DNA, 4741 bp, Homo sapiens
gcctcactattgctagtcgaggctggctttaatcggccgagggtcctcttgcgttgtatttaaggtggctcgggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcgggggga

SEQ ID NO: 358513 - DNA, 4760 bp, Homo sapiens
ccccgcccggtactttttccggaggcggcccaagcggcagttggctgcagaggaccccacgtttaggattttatagggaagaggaggaatttttcgtagaaatccccgctctgcgtgctcgtggtggaggctgctggcaatggcctacgtcgtcataccgggcttccttgccctgtccgggggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcgggggga

SEQ ID NO: 358514 - DNA, 4695 bp, Homo sapiens
gcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcgggggga

SEQ ID NO: 358515 - DNA, 4387 bp, Homo sapiens
cctcctctccgggactgagctgtaaggaacagacctctctggctatcgttggggagtgaggcaaagttaccgtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcgggggga

SEQ ID NO: 358516 - DNA, 4284 bp, Homo sapiens
  misc_feature (4)..(4): n is a, c, g, or t
gaanccgattaatcctccagttggttgtccctgccgtctcggaagggttagcacacagccaggtctgtttttgatgtatgtaattgaagatttataaagaaaagcttctcctctgcctcatccacagtcattttttttccaatgccagttcccagcaggcatataaatattggtcgttctcagagctgggatgctgctgggtggtacgagggcccctgggagaacgccgagtccctgcggcctctggggaggagaagctccctgacgtatggcacagcagaggggacttggtttgagccaaaccaccgaccacaggacgctgccctgcccgtggccgccgagccctacctgtaccgggaggccgtttataactcagtggctgcaagaaaggggtctactcctgacttcaccttctacgacagcagacaggcagtgatgtctggtcgcagccccctgctgccacgggagtactacagtgatccgtctggagctgctagggtacccaaagagcctcccctctatcgggacccaggagtcagccggccggtccccagctacggagtgcttggcagcagaacgtcatgggatccaatgcaaggccggtcacctgccctgcaggacgccggtcacctgtaccgggatcctggaggtaaaatgatccctcaggggcggcagacacagagcagggctgcatctcccgggcggtatggacgggagcagcccgacaccaggtatggggcggaggtgcctgcctaccccctcagccaggtcttcagcgacatcagcgaaagacccattgaccctgcccctgccagacaggtggccccgacgtgcctggttgtggaccccagttcagctgctgcccccgaaggcagcacaggggtggccccaggggccctgaatcgtggctacgggcctgcccgggaaagcatcccatccaagatggcttacgagacttacgaagctgacctgtccaccttccagggtcctggtggcaagaggaccgtgctccctgagttcctggcctttctgcgggcggaggggctggcagaggccacgctgggagccctactgcagcagggctttgactccccggccgtcctggctaccctggaggacgcggatatcaagtctgtcgcacccaacctgggccaggcccgtgttctgagccgcctggccaatagctgcaggaccgaaatgcagctgcggaggcaggaccgggggggcccgctgccccgggcgcggtccagcagcttcagccaccgaagcgaactgctccatggtgacttggcttctctgggcgctgcggctcctctgcagacagcatccccccgagctggagacccggctcgccgtccctccagcgcaccatctcagcacctcctggagacggcagccacctattctgcccctggcgtgggcacccatgccccacacttcccctccaactccgggtacagctctcccaccccttgcgccctgacagcgcgtctgagccccacgcaccccctgcaggcaggggtggccttgactaacccgggcccctcaaacccccttcacccaggccccagaacagcttactccacggcatacacggtgcccatggagctgctaaagagggagcgcaacgtggccgcctctccgctgcccagccctcacggcagcccccaggtcttgcggaagccaggtgcacccctggggccatccaccctgccgccggccagccagagcctccacacgcctcactcaccgtacgagaaggtggcccggcgcacaggggcacccatcatcgtgtccaccatgcttgcaccagaaccaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaattt

SEQ ID NO: 358517 - DNA, 4585 bp, Homo sapiens
tccctgtgtgcgtgtgtcattttaaggtggctcgggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcagttgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccgtccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcgggggga

SEQ ID NO: 358518 - DNA, 2036 bp, Homo sapiens
tccctgtgtgcgtgtgtcattttaaggtggctcgggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcagtgtgcttccggggtaccgagctct

SEQ ID NO: 358519 - DNA, 1259 bp, Homo sapiens
tccctgtgtgcgtgtgtcattttaaggtggctcgggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcagatgagattcgggcatctttcaacgacatgacaaagtgaaggctctactatgcacgtcaggcgcg

SEQ ID NO: 358520 - DNA, 924 bp, Homo sapiens
taaaggcaggctgttacggcccggattttaggatcagccagcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttaaacctcccctaattaaagtctctttatccctttggggctgcaaaaaaaaaa

SEQ ID NO: 358521 - DNA, 1531 bp, Homo sapiens
ggcgagtgcaagcttgatgcgtgtggtcgaacttaggaggatccccctcactagactgcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcataaaaaaaaaaaaaaaaaaacaaaaaaacaaaaaaaaaaaaaaaaaaaaaagaacaaaaaacaaaaaacaacaaa

SEQ ID NO: 358522 - DNA, 1450 bp, Homo sapiens
aggcatcgcggggctggccacttccgtacttccgctttccggcccagccagcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcat

SEQ ID NO: 358523 - DNA, 1583 bp, Homo sapiens
gggagtcagcgagggcgagcctactggagtttgccgggggtgggaagaaggtgggcctcgagcaaagccgctagaggtggggtgcgggtggtcggcctcaggcgagccccggggcacagcccggggcgggaggcggagcttggcggccgagatctccgcgctgcagttagccccgccgagcgccaggagctgcggactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcat

SEQ ID NO: 358524 - DNA, 1438 bp, Homo sapiens
gggagtcagcgagggcgagcctactggagtttgccgggggtgggaagaagactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcat

SEQ ID NO: 358525 - DNA, 1331 bp, Homo sapiens
aggcatcgcggggctggccacttccgtacttccgctttccggcccagccagcgcccgcgatggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcat

SEQ ID NO: 358526 - DNA, 941 bp, Homo sapiens
ggcgagtgcaagcttgatgcgtgtggtcgaacttaggaggatccccctcactagactgcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttaaacctcccctaattaaagtctctttatccctttggggctgcaaaaaaaaaa

SEQ ID NO: 358527 - DNA, 693 bp, Homo sapiens
ggcgagtgcaagcttgatgcgtgtggtcgaacttaggaggatccccctcactagactgcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatgtttcccggtcctctggcgaggatcctccaaggcgtctcacatgaaccggctcagaaacgccaaaatctacgtggagagagctgtcaagcagaagaagatctttacaatccaaggctgctacccgg

SEQ ID NO: 358528 - DNA, 1435 bp, Homo sapiens
  misc_feature (14)..(14): n is a, c, g, or t
  misc_feature (22)..(22): n is a, c, g, or t
gctggtaccggtcngagtcgtnggatggccagccagcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcat

SEQ ID NO: 358529 - DNA, 1457 bp, Homo sapiens
ggcgagtgcaagcttgatgcgtgtggtcgaacttaggaggatccccctcactagactgcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcat

SEQ ID NO: 358530 - DNA, 1440 bp, Homo sapiens
taaaggcaggctgttacggcccggattttaggatcagccagcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcat

SEQ ID NO: 358531 - DNA, 1442 bp, Homo sapiens
ccacgcgtcgcggacgcgtgggtcgacccacgcgtgcgggcagcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcat

SEQ ID NO: 358532 - DNA, 1037 bp, Homo sapiens
ggcgagtgcaagcttgatgcgtgtggtcgaacttaggaggatccccctcactagactgcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctcccctaattaaagtctctttttgcccctttggggctgcat

SEQ ID NO: 358533 - DNA, 1086 bp, Homo sapiens
cccctccctactgtcttcttcccaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcat

SEQ ID NO: 358534 - DNA, 595 bp, Homo sapiens
ggcgagtgcaagcttgatgcgtgtggtcgaacttaggaggatccccctcactagactgcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggtgagaccctgtgacccatgagtttgcgatacccaggaccctgttacagaatggcctgggattgtttctagaaccagctactccagctgtttggcacccactgcctgaattgagagttggccttcatcttggagtgggagcaaagaggtatcacttgagcttagaggatcagctggagcgcagagatcactgaactgtt

SEQ ID NO: 358535 - DNA, 3584 bp, Homo sapiens
taaaaaagcatgccttcattccaaatccccagattccggctctcaggaatgtttcagggtaaaacttggggcaaagcaaggccgttatgatgggggtggatctaagaagccagcagcagggaggcgtggggtctgtgctctagcgttaaagggagggttctagactaacgagggcgggtcggcccgactaagtgacttaaactcccacctactcctggaataaggagtcaaagcccggataggcgcagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358536 - DNA, 570 bp, Homo sapiens
acctcatctcaggaataagggccaggtagctagctgagctaatcctcctgtctgtttcctcctcccccaggtgtttcagtcacctccagtaacacgggcgtgccagatatctcgggttctgtgtactccaaaacccaggtaggtgcctggctctggataaaagtggaaaagagatagacatagaggaggtggagttgcaatggtagaaataacagtggacaagaagaaccctaggagaggtggcaggaaacccatcctactttttctaaatgaaaggtcttctctagacttcacttcctctaagaagttaaaatttagccctctgagaaaaaaaacgagaaacgtaataggaaggtaaagcgtggcaaattgtttaacgtgtcatgtaatttactgtgcaactctcctggccccttttcctacctactccccaacctttttcataacttttcaagagaataagtatgagagtgacaggaaactagttcattccattctttgagtaaatctataacagtgggagtgggaaaggagagacctagtaacctaatgaagcatttgagtgatcca

SEQ ID NO: 358537 - DNA, 462 bp, Homo sapiens
  misc_feature (8)..(8): n is a, c, g, or t
aacttganccagatatgggacgagtgcatggaggactgcaacagaggagtgggggactgaagattggaatgaagatgtaggtattcccaggtcattcctcactaatgccttctatccctaagtgttgtttagggatagaaaatgggtatgtttctacccctcaaaattcacccttaagattctgacccaaaacttttacatccaaaatagtgttctgagccagaacatttcacatatgttatatgaaggagactgggcatgaacaggactctgtggaaccacactatggaaagggcaagtgcacttgtgtaagtccaatatctgattgtcggatttatcccaggaagagattggtggttgggtagggcaccagaagtggagttaggcaggtagtgcattgagtaacagctgctggtggtacatgactacttggtgcatttaagtatttgctataaggtcctg

SEQ ID NO: 358538 - DNA, 403 bp, Homo sapiens
cccaaattccccccccccccccctttttttttgggggaaaaaaaaaaaaaaaaaaaaatggttttttttttttcccaaaggccaaaaaaaaaaataaaggggttgtgggaaaaaaaaaaccccgcccccccccccaggattttttttggtgttttttaaaaaaacccccccttttttttgttttaaaaaaaaaaaaaaaaaaaaaaaagggggcccccccctttttttttttttttttttttttttttttttttttttttttttttttttttttttttttggttttttttttgttttttttttttttttgtactgtgtcctcaaatttaatggattaatgtgtcttgtatatataaaaagaaaacctctaccttcagcctctgcctattcttgctccgtctag

SEQ ID NO: 358539 - DNA, 3456 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358540 - DNA, 3455 bp, Homo sapiens
cgccgtgaaggaggcggggtggactcgcggagccggaaagaggtgtctcgtggcgaggcggcacgcgcacgcttgcgtgcgcgccccttttagcgtcacgcgctgagggacgcaggaagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358541 - DNA, 4009 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttcagcctctgcctattcttgctccgtctag

SEQ ID NO: 358542 - DNA, 3528 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcatagggacatggcgcaagtccctgtgcatcaatgtgggtcagcctctagcattcttctagtcatggacagcatcctacacaatcgcatcctcgttgtggtacatggtgctctgtacgagaacgaatcacccaatcacgtggttgcatcgtatgattgtggataggaatcgcaagagtagattcgaggcgaggtaagtccaccagcaccactttacaaaaagcagcacaagagcatttatacccgctatcttcgaacgcattgctgtgacggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358543 - DNA, 3962 bp, Homo sapiens
  misc_feature (3961)..(3962): n is a, c, g, or t
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgtaaann

SEQ ID NO: 358544 - DNA, 4643 bp, Homo sapiens
  misc_feature (4642)..(4643): n is a, c, g, or t
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttcagcctctgcctattcttgctccgtctaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgtaaann

SEQ ID NO: 358545 - DNA, 1970 bp, Homo sapiens
tagccttggaagtgtgccgctgtttcaaagtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358546 - DNA, 4013 bp, Homo sapiens
  misc_feature (4012)..(4013): n is a, c, g, or t
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagctaccatatttgcagatgattctctgttgccagcgccagcaggaggagcaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgtaaann

SEQ ID NO: 358547 - DNA, 3442 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccaggacatcctcaatttcgtcgatgaccagcttggtgaataagtattactgtaccaactgggcctcctctagcaggcccctgaaggcagtggaataaaatgaaatcttcgcccttta

SEQ ID NO: 358548 - DNA, 3562 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccaggtaggtgcctggctctggataaaagtggaaaagagatagacatagaggaggtggagttgcaatggtagaaataacagtggacaagaagaaccctaggagaggtggcaggaaacccatcctactttttctaaatgaaaggtcttctctagacttcacttcctctaagaagttaaaatttagccctctgagaaaaaaaacgagaaacgtaataggaaggtaaagcgtggcaaattgtttaacgtgtcatgtaatttactgtgcaactctcctggccccttttcctacctactccccaacctttttcataacttttcaagagaataagtatgagagtgacaggaaactagttcattccattctttgagtaaatctataacagtgggagtgggaaaggagagacctagtaacctaatgaagcatttgagtgatcca

SEQ ID NO: 358549 - DNA, 3183 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358550 - DNA, 1242 bp, Homo sapiens
cggtcacatgctccacacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358551 - DNA, 3641 bp, Homo sapiens
  misc_feature (3640)..(3641): n is a, c, g, or t
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattgcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgtaaann

SEQ ID NO: 358552 - DNA, 2790 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggggctggggaggaggcatccccacggccggtcga

SEQ ID NO: 358553 - DNA, 2717 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattgattgctacagcatcccatttcccacaccctctgacaacggggcatcctctagggtcgtccc

SEQ ID NO: 358554 - DNA, 2930 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcagcctcctgagtagctgggattacaggtgcccaccaccgcgcctgctaatttttgtattttttagtagagacggggtttcaccatcttggctaggctggtctcgaactcctgacatcatgatctgcccaccttggcctcccaaagtgctagattacaggcgtgagccactgttcctggccttcagtcttatctgtaagttcctgtctgcaccctgtgctcttgtctgtacatctactctcctatgaataggaaagtaaagttttctacatctgtgccttcgctgatgttgtttccttgtcttggaatggcctttcccccactaccttccctttctttttatcagacctccccctctttctttcttttttaaagccacaggttgaaacttgaaacctgatcatttcagttttgcttcctt

SEQ ID NO: 358555 - DNA, 1200 bp, Homo sapiens
tatttttaagccagattttgaagagtataagagacagagacttgtagaatagagagtaaaactggttgttcgtgtatgttttgtgtctactctattggtatcaagaagccagcctactagaatcagtagtatttagctcaaggaaagcttcaagacctttcatgaatcatttaatctctgtgtactttactgctttttccttaaataaaattgaaggaaataatccgtgtcctgttctaacccagaatgaggatgaatgttctgttgaattagcttgtctcttggctccttgttttgctaacatcatgaccagttcctgttattgctatatgtctgtatctttcagccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358556 - DNA, 1764 bp, Homo sapiens
ccactgctcccccttttgaagcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagctaccatatttgcagatgattctctgttgccagcgccagcaggaggagcagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttcagcctctgcctattcttgctccgtctag

SEQ ID NO: 358557 - DNA, 1890 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgcatcatccttcatacaactttccactcctcaccagcagtcaggccaactggtccaccggtacga

SEQ ID NO: 358558 - DNA, 552 bp, Homo sapiens
taaaagaatgaattgaaaaatatttttgggaagagaaaaagagagcttgagtgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358559 - DNA, 2522 bp, Homo sapiens
  misc_feature (2521)..(2522): n is a, c, g, or t
tcttgagatggagtctccctctgtctcccaggctggagtgcagtggcacagtcttgactcactgcaacctccacctcccaggttcaagtgattctcctgcctcagactcccaagtagctggattacaggcgcccgccaccatgcccggctaatttttgtatttttagtagagacggggtttcaccatattggccagactggtcttaaactcctgaccttgtgtgatccacccatcttggcctcccaaagtgctgggattacagatgtgagccaccatgcccagcctatttggtctttacaacaggtttgtagcatccctgttttatatctgaggaaactgaggctaagagattgagtagtatgcccaggttcacacagttcttaaataagagcagagctgagactgagacctgaatatgtgacttcaagtgtactgtgccttctgtgacaccatgctgctttctgagggtcagggagcttgagctcaggaaaaatcccaagactagtttgctgatcccttttactctgtctcctcctggcctcctggatagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccaggtaatagcccttccccttctctcctttcccttcctcttccttcctatcccttaaaactgccttccctttccttttcttacccttcctcaccaccaccttcacccaatccctccccagcgccagtcatgggcacacagcacatacagacacaagcgcacataacacgagcggccggcaaaggaaatctcagagaagggccgggttgaaaccttttttgcccaattcctttggtgcccttctcctcctgtgccacagttgtcctcatcccatcagacctgggtcacaccttccctctttcctctcccagccttccctcttccctgacattttagctttcccttctaatggtggagttctattgtcaaagtttgtccctttattttccatatatcctggttctgcctcagctaccatatttgcagatgattctctgttgccagcgccagcaggaggagcagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttcagcctctgcctattcttgctccgtctaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgtaaann

SEQ ID NO: 358560 - DNA, 1659 bp, Homo sapiens
  misc_feature (45)..(45): n is a, c, g, or t
  misc_feature (58)..(58): n is a, c, g, or t
  misc_feature (75)..(75): n is a, c, g, or t
  misc_feature (77)..(77): n is a, c, g, or t
  misc_feature (1658)..(1659): n is a, c, g, or t
atcgtaaccgttcgtacgagaatcgctgtcctctccttgctcganatccattgtgctntaaagatggatacaacncnggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttcagcctctgcctattcttgctccgtctaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgtaaann

SEQ ID NO: 358561 - DNA, 2109 bp, Homo sapiens
  misc_feature (2108)..(2109): n is a, c, g, or t
acctcatctcaggaataagggccaggtagctagctgagctaatcctcctgtctgtttcctcctcccccaggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccaggtaatagcccttccccttctctcctttcccttcctcttccttcctatcccttaaaactgccttccctttccttttcttacccttcctcaccaccaccttcacccaatccctccccagcgccagtcatgggcacacagcacatacagacacaagcgcacataacacgagcggccggcaaaggaaatctcagagaagggccgggttgaaaccttttttgcccaattcctttggtgcccttctcctcctgtgccacagttgtcctcatcccatcagacctgggtcacaccttccctctttcctctcccagccttccctcttccctgacattttagctttcccttctaatggtggagttctattgtcaaagtttgtccctttattttccatatatcctggttctgcctcagctaccatatttgcagatgattctctgttgccagcgccagcaggaggagcagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttcagcctctgcctattcttgctccgtctaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgtaaann

SEQ ID NO: 358562 - DNA, 775 bp, Homo sapiens
gggtcatgagttaaattaaacaaatcctgagaagccccattgagatttaatacatagactccttgtggccacccctgtcattgagcaaggttcaccctaaatcttggtggggaggattataagccttttgacttggagtggtggcccctttctgaggacattaggttgaagtcttagttggaccaggttcacgaattttaagaggtaggtgatggataatataagagaattggcatacctgattctagaaatcccaccttcttgcctcccttcagaattcagaaacgtattatatcagcccttgagaacccccagttcccaaccccacaaagggcttttgtcattccattcatttatttttatgtatttgattccttttaggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358563 - DNA, 1273 bp, Homo sapiens
  misc_feature (1272)..(1273): n is a, c, g, or t
ctccttctttattattaggaaaacaacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttcagcctctgcctattcttgctccgtctaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgtaaann

SEQ ID NO: 358564 - DNA, 1302 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatgtaggtattcccaggtcattcctcactaatgccttctatccctaagtgttgtttagggatagaaaatgggtatgtttctacccctcaaaattcacccttaagattctgacccaaaacttttacatccaaaatagtgttctgagccagaacatttcacatatgttatatgaaggagactgggcatgaacaggactctgtggaaccacactatggaaagggcaagtgcacttgtgtaagtccaatatctgattgtcggatttatcccaggaagagattggtggttgggtagggcaccagaagtggagttaggcaggtagtgcattgagtaacagctgctggtggtacatgactacttggtgcatttaagtatttgctataaggtcctg

SEQ ID NO: 358565 - DNA, 683 bp, Homo sapiens
taaaaaagcatgccttcattccaaatccccagattccggctctcaggaatgtttcagggtaaaacttggggcaaagcaaggccgttatgatgggggtggatctaagaagccagcagcagggaggcgtggggtctgtgctctagcgttaaagggagggttctagactaacgagggcgggtcggcccgactaagtgacttaaactcccacctactcctggaataaggagtcaaagcccggataggcgcagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgacctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358566 - DNA, 432 bp, Homo sapiens
acctttaacccagctgattatgcagagccagccaatactgatgataactatggcaatagcagcggcaatacgtggaacaacactggccactttgaaccagatgatgggacgagtgagtgaccatttatcattcatttcttgtctctgggaatctaaggaaatagttttttctgattatacttacattaaaacgtggaagaatagtgtttggttatggagatagggtgagaaagggctggcagttgtattactgtgtgtactgtttatgtaacgtgcatatgggcacattacacatgttatttcgcttaatgctgcttgatattgtatgaaataatcattatttatcatcactttccagatgacaaaactaaggccgaaagagaggttataaatttgctagtatttgaactcagcattgtttgaccctgaaag

SEQ ID NO: 358567 - DNA, 433 bp, Homo sapiens
tctggataagtgtctttatgagtagctgaacaaggttactggctgtaggtttctctcatctctttgttgatctacaggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatggtgagaagatggaaagtgacttgaatctttaaagcattggagcattactgtcaagaggctagcagggggagggggtggagaatgtgtcctgaagtgaagaaaaggggcagctagttggttaccttcccacatgtatttcccctaatcaaataagctg

SEQ ID NO: 358568 - DNA, 282 bp, Homo sapiens
tctccattaaggcacattaccattccctgagaaacatgttcccatccttccagctcattttctcttcgttgtttttttaattcccaataccatattacataccatttatatatttgtatatatcctgttgactgtgctctggccatctgtggtttggtttttttgttgttgttgttgttttaatttttatttttatttcagttcgaggtcaggaaaatggattggatggcaccaagagtggagggccttctggaagaggaacagaaagaggcagaaggggcc

SEQ ID NO: 358569 - DNA, 406 bp, Homo sapiens
ccttcactctcccactcaaacaaaacagacacagcacaagcagggcacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccattttcctgacctcgaaactctcgtccacgactggcacctctcccccgtcttggtggcccaccacgtcgccgactatagtctctgtcccggtctcgat

SEQ ID NO: 358570 - DNA, 3405 bp, Homo sapiens
atgcggctagagcctgagaggggagagcgagaaagagcgcgagcgagcgaggcctgggccttgcctgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358571 - DNA, 3391 bp, Homo sapiens
tatatcacgtgacaggggcggcgcggcccggggtgtcagtgtggaggagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358572 - DNA, 4060 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagctaccatatttgcagatgattctctgttgccagcgccagcaggaggagcagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttcagcctctgcctattcttgctccgtctag

SEQ ID NO: 358573 - DNA, 3588 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccggtaagtgggactaaaggatcttcttcaaaagaatgaggatgaatgttctgttgaattagcttgtctcttggctccttgttttgctaacatcatgaccagttcctgttattgctatatgtctgtatctttcagccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358574 - DNA, 5101 bp, Homo sapiens
  misc_feature (5100)..(5101): n is a, c, g, or t
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccaggtaatagcccttccccttctctcctttcccttcctcttccttcctatcccttaaaactgccttccctttccttttcttacccttcctcaccaccaccttcacccaatccctccccagcgccagtcatgggcacacagcacatacagacacaagcgcacataacacgagcggccggcaaaggaaatctcagagaagggccgggttgaaaccttttttgcccaattcctttggtgcccttctcctcctgtgccacagttgtcctcatcccatcagacctgggtcacaccttccctctttcctctcccagccttccctcttccctgacattttagctttcccttctaatggtggagttctattgtcaaagtttgtccctttattttccatatatcctggttctgcctcagctaccatatttgcagatgattctctgttgccagcgccagcaggaggagcagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttcagcctctgcctattcttgctccgtctaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgtaaann

SEQ ID NO: 358575 - DNA, 4123 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttcagcctctgcctattcttgctccgtctaggacatcctcaatttcgtcgatgaccagcttggtgaataagtattactgtaccaactgggcctcctctagcaggcccctgaaggcagtggaataaaatgaaatcttcgcccttta

SEQ ID NO: 358576 - DNA, 3336 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtaagctgaccttgtctctggctcggtgttatctgtggggtgttattggataaatttcagggaggaagacttggtgcttgagaaaatgggattggtgagggtgtgccgctgccccaggtatgattgttaatgcttggctgacttgggtatctgtgggagcagcaccaacagaggagcttgatactaggacatgtgtccactatttgtgacgggaatgcccaagagtatgtgttggtttttagaatatgttggttggccaaaagtgtgggtggaa

SEQ ID NO: 358577 - DNA, 1448 bp, Homo sapiens
agaggatcccgccttccgaccacgaagttcgtagaacctgactacatctcgtggtaggtgctatgaagacatctgcgggtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358578 - DNA, 3037 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttcgaagcatcaatgcacacacctgctgttgcttttgatttctggaaggcatgtagtttcaacttgtaacaaaaatatttgtagtcttcaataaactgtggtatttct

SEQ ID NO: 358579 - DNA, 1200 bp, Homo sapiens
agtggtgagaaggtgtacaggacatcacatcttctgggcgcacttcgacatccactctttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttct

SEQ ID NO: 358580 - DNA, 2960 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccggtaagtgggactaaaggatcttcttcaaaaggtgaggatgttgtggctactctttttatagctctggcttcagatggacccctgtgaataccaaaacttgcacatactcaagccctgcagttggctctgtggaatccatgtatatgagttttgcattctgtaaatgtggccgtatttttgatctgtgtgtctggttggaaaaaattcatatataaacagcgtgcagttcaaacctgtgttaagggtcaactgtaattaaaatataaaataaatgagggattgccacatgtaatcaaactggtttttaatctttgcagttttggaaaaaatactaaactgaggccaacccatctattgt

SEQ ID NO: 358581 - DNA, 2407 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacaacactgttggagatgtcagagcgtatctccattctccctcctgcacctttccacccacatccgtatctgaccccgggatcctctgc

SEQ ID NO: 358582 - DNA, 2700 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaaggtagtggcttcatgaacccttgggaattggttaggagaatagtgggcaaaaattccttaaatattagtgttttacttttcagcaagtggtgctaagaaactttggaagtagtgattgagaatttgaaaaaggcacacatctgtggctagtgaattaaaagttcttatcagcaaacccggagactgaagagccaggaaaccattctctttgtactaaaaattcattgcctctagtagaatcagtctcaagtgcctgtcctgtcttctgggaagatgtgattgccagatttctgggtgcgtgtcagtagacctcaccttgctaagtcctggcatggtgagggagacagcatgtgccagaggtgatgtggagtgagtgtcagatgcagccagcggaataggtggtgtggctgaactgttgtacttacccttccccaaaaatcactggatgtggactttgggcctttcctctatctgttttaggtttggggtgtcttcaacaatttgtagggtttccttcttttgcttttggtcacacagtgttggtatatctcagttttgttgtttaatttttgttcctattttggttttttggatagtctacattgtattaatattaatccttttggttaatttacagagtttctcctaaagatttgttgaccaaaataaagctgcatcagtgctaac

SEQ ID NO: 358583 - DNA, 1743 bp, Homo sapiens
tatatcacgtgacaggggcggcgcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatggtgagaagatggaaagtgacttgaatctttaaagcattggagcattactgtcaagaggctagcagggggagggggtggagaatgtgtcctgaagtgaagaaaaggggcagctagttggttaccttcccacatgtatttcccctaatcaaataagctgaattcaagaagttggggaataataaaatttgaggctatgtatttctcatcacatttagaggctgggcatggtagcttacacctgtaatcctagcactttgggaggttgaagtgggaggacagcctgagccttaggagttcaagaacagcctgagcaacatatcaagactccatttctaaaaaaattgttttcaattagctgagtgcggtggtg

SEQ ID NO: 358584 - DNA, 1668 bp, Homo sapiens
  misc_feature (56)..(56): n is a, c, g, or t
  misc_feature (67)..(67): n is a, c, g, or t
  misc_feature (103)..(103): n is a, c, g, or t
  misc_feature (1667)..(1668): n is a, c, g, or t
aaagcccagtggttttgttttatggaaacaaaactgttttttagtcccctccagtnaaacgggcgtnccaggtttttcgggttttgtgtactcccaaaccccngcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagctaccatatttgcagatgattctctgttgccagcgccagcaggaggagcagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttcagcctctgcctattcttgctccgtctaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgtaaann

SEQ ID NO: 358585 - DNA, 3484 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358586 - DNA, 1218 bp, Homo sapiens
cttgcccgggaaaacgagcatgatacgattgagctcgtacccgtcttgcacttttccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358587 - DNA, 1124 bp, Homo sapiens
ttggactttttttttttttttttttttttttgagacggagtctcgctctttcgcccaggctggactgcagtggtgtgatctcggctcactgcaagctccgcctcctaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358588 - DNA, 1547 bp, Homo sapiens
aaaaaagttaagtgcaaagaatcaagcctggtatgttagttttcatcactgagattcagccaagatggaattagagtgcaagataatttaccggggggaccaccatgaggaaaagtggagtagaagtgggaggagcctgagagagccctcagaccacgatgcagatctgattcctgagaaggagaaagaggagagagttttagatagtgatgcagttctcagagtttccacaaggctggtggggcgtcctcaagcccctcacccatgagagagaagcagagtcccccagaactgggcttttcattcccctggtgggagcccatgagaagcgagttctctgtgcaacggacttagtaaatacagaatgcactagcctgggccttctgccaatcaagtccctgccacagagacccaacagacttatttatgcctaccacaactgagacactgagaaaaagatgcaaccatgaaaagatagaaagttctaatgacacgcaaaaatagcaatcagactttctcaaatttcaaagccttcagaaatagctgagtgcagacaggccagggtggaattgacagaagactgatcaccaactagcaacacagtgagagagaaaaaattgcaactttcccacaaaactaatgcattccttgaagcaacaagtagagactgcttcatgctgagagctggaacctggggcaccccactgtaaaataacatcacattcattccttctcttttctttccatgacggacgattcaatacattgtcaaagcctcttggtccttttttaacatctcacacttgtgtcattctctccattcccataaacctcaacaactgctcaaagtcctgcttgaccccttgttgccagtctttgaaatctttcttgcatatgactgcctcattaccttcctaaaatctagttcactcgcctactcaagaagacacaggggcctactgtggtgtattagataagttcacatttcttctctttactaatcttttttacttcctttaccaccactcccttatataattccatcatcctaatagatctgtttccctacacatccctgcctctccaccccacatgtacacagaattcttagttccggtgttacacctaaaaacatgtcaaacagggtgacctccttccactgtctgcactgtggagttacccacacccttaatcacaagcaacttctgacctcatgaagaacaaagactgtagcattaacctgtgagtcttaagctcaggacacaactgtgcctgtgactgagaaccttttcctgataaccaattcatatgttcataacagatacagaaatgaagaaggcaaggtccttaattctataacaggagacaaaacctgaaaaataatcataatgccaaaatagaaaggagtgaacatcacaagaaattagagaaatctgacggaaaatatagctacacattggaatcactcagaaacattttataaaatggatacttaagtcccaccgataaattccgatttactgatctataggagtggtgaggcattc

SEQ ID NO: 358589 - DNA, 856 bp, Homo sapiens
aactcctgatctgcccgcctcggcctcccaaagtgctgggattacaggcgtgagccaccgcacccggccgatttggactttttaacacaggattgggacaggattcagagggacactgtggcccttctacaatcaggagcttcccctttcctctgatgacatcacctgtggctttgttctctttgttccagatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacac

SEQ ID NO: 358590 - DNA, 955 bp, Homo sapiens
  misc_feature (922)..(922): n is a, c, g, or t
gacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacagtgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactntggggaaggggggacctctagactacgcaggcc

SEQ ID NO: 358591 - DNA, 842 bp, Homo sapiens
  misc_feature (10)..(10): n is a, c, g, or t
  misc_feature (163)..(163): n is a, c, g, or t
  misc_feature (165)..(165): n is a, c, g, or t
caagtttttntttaaactgttacccgaagagcagatgtatactgaacttgtgcactaactatatgaccatacgataccaatattcaagaatagtttccctagtctggggcgtccacatagggcgacaatgtaaaagtctctatttttgttcacaaaagtatantntatcaaattgctgaaggctttggatagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358592 - DNA, 596 bp, Homo sapiens
taattttttccacacagaaattgggagaattttggaaaggtggccggggttgggggttgcttctaaaataaccagcccttggtgtagtttttttcatttcagaaagactgacagttgttttgcttcttccttaaagcatttgcaacagctacagtctaaaattgcttctttaccaaggatatttacagaaaagactctgaccagagatcgagaccatcctagccaacatcgtgactcgtgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaatttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaat

SEQ ID NO: 358593 - DNA, 297 bp, Homo sapiens
gctgttctatgaggatccctagtatgtgagacgccttgtaaggtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctcttccagggactcaggcccaaatccctaagcctgtccctgtgccagggtggatgcagcggaagctccctgggaggccctgccagtgggccccaggcccgcagaggcttttgggagg

SEQ ID NO: 358594 - DNA, 3884 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctgtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358595 - DNA, 3688 bp, Homo sapiens
gacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacagtgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358596 - DNA, 3301 bp, Homo sapiens
tctagaggatcccgcatgtcgggcatgattgcgatagttcatgtataaatcgcgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358597 - DNA, 3284 bp, Homo sapiens
tttaaagtttgcagatgagcttatgggggcaaatcttaaaaagtccccagcagatggcatccggctcgagggcccatcacttttgaataaatgcttgttccagagcccatgaatgccagcagccacccctcctttcctgggttaaagtttttcagacgctgcatcttctaaattgagcctccatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358598 - DNA, 2789 bp, Homo sapiens
caggcgtcgctatcacaaacgtcgctgagtggtgaaagaccgtagcgatgtattgtggaatccataacctgaatgatctgttgaccacgatgacccagtcatcctgaatgtccgctatggcccagacgagcccatccattaccacctctcatatcgcctgattagcgtccaggggatgaacctcaccctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358599 - DNA, 3286 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactggtaggtataatggcctttcctcttgttctgtttcctgcagtgctgactgccatgcttgggagagggaagggatttcttcacctgtatctgggactggatctcttcctcctacccccaagctcctgcttctcagcactaattcctgcaggtctcttcttccctggtcttcatgctccctgtacgccactgtctcttagatataattatccccaccctctgctcatttgtttcccagattcaatacattgtcaaagcctcttggtccttttttaacatctcacacttgtgtcattctctccattcccataaacctcaacaactgctcaaagtcctgcttgaccccttgttgccagtctttgaaatctttcttgcatatgactgcctcattaccttcctaaaatctagttcactcgcctactcaagaagacacaggggcctactgtggtgtattagataagttcacatttcttctctttactaatcttttttacttcctttaccaccactcccttatataattccatcatcctaatagatctgtttccctacacatccctgcctctccaccccacatgtacacagaattcttagttccggtgttacacctaaaaacatgtcaaacagggtgacctccttccactgtctgcactgtggagttacccacacccttaatcacaagcaacttctgacctcatgaagaacaaagactgtagcattaacctgtgagtcttaagctcaggacacaactgtgcctgtgactgagaaccttttcctgataaccaattcatatgttcataacagatacagaaatgaagaaggcaaggtccttaattctataacaggagacaaaacctgaaaaataatcataatgccaaaatagaaaggagtgaacatcacaagaaattagagaaatctgacggaaaatatagctacacattggaatcactcagaaacattttataaaatggatacttaagtcccaccgataaattccgatttactgatctataggagtggtgaggcattc

SEQ ID NO: 358600 - DNA, 3154 bp, Homo sapiens
gacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacagtgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagccagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358601 - DNA, 3459 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358602 - DNA, 2950 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358603 - DNA, 2619 bp, Homo sapiens
gaatgataggtgcagtgagattcactcaattgagctgatcgattttataaacgtcgtcgaccttgagtcagaactctggcgtctgatcagagacaggccacccaatcacagcaggtgcttggaggggagtggaatctcagtagagttgatgactcaccaagtgcaaatgggaaaaagcaacacagtcacatttccatgtatacccggcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358604 - DNA, 2550 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacac

SEQ ID NO: 358605 - DNA, 2394 bp, Homo sapiens
tccagtcggacctgctgctttctcccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358606 - DNA, 2113 bp, Homo sapiens
  misc_feature (2046)..(2046): n is a, c, g, or t
  misc_feature (2068)..(2068): n is a, c, g, or t
  misc_feature (2078)..(2078): n is a, c, g, or t
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctgatgggagcaagactgatcttctcccatcagcattttgtaaatcaatgtgaaatttgcaaacaagctaagatacattttcttgaaaattgtcctaatttttgattgtatagtttngtcttctgtgattctatctgtncaggcatatnagcataaatttttcatatcgatcacaacatatcac

SEQ ID NO: 358607 - DNA, 1948 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcagtgtcccccccagaaatatcagggaggatcctctgaacacac

SEQ ID NO: 358608 - DNA, 1863 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgac

SEQ ID NO: 358609 - DNA, 1645 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataccgcccagggggttttccagtctaagagagagtagcaagtagatccagacgcagccacaaaccgatatatccagctgaatacagcaagtg

SEQ ID NO: 358610 - DNA, 1747 bp, Homo sapiens
tggtgattagaggatcccccgctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358611 - DNA, 1790 bp, Homo sapiens
aactcctgatctgcccgcctcggcctcccaaagtgctgggattacaggcgtgagccaccgcacccggccgatttggactttttaacacaggattgggacaggattcagagggacactgtggcccttctacaatcaggagcttcccctttcctctgatgacatcacctgtggctttgttctctttgttccagatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358612 - DNA, 1448 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctcccgagtaactgggattacacacacgtgcc

SEQ ID NO: 358613 - DNA, 2099 bp, Homo sapiens
aaaaaagttaagtgcaaagaatcaagcctggtatgttagttttcatcactgagattcagccaagatggaattagagtgcaagataatttaccggggggaccaccatgaggaaaagtggagtagaagtgggaggagcctgagagagccctcagaccacgatgcagatctgattcctgagaaggagaaagaggagagagttttagatagtgatgcagttctcagagtttccacaaggctggtggggcgtcctcaagcccctcacccatgagagagaagcagagtcccccagaactgggcttttcattcccctggtgggagcccatgagaagcgagttctctgtgcaacggacttagtaaatacagaatgcactagcctgggccttctgccaatcaagtccctgccacagagacccaacagacttatttatgcctaccacaactgagacactgagaaaaagatgcaaccatgaaaagatagaaagttctaatgacacgcaaaaatagcaatcagactttctcaaatttcaaagccttcagaaatagctgagtgcagacaggccagggtggaattgacagaagactgatcaccaactagcaacacagtgagagagaaaaaattgcaactttcccacaaaactaatgcattccttgaagcaacaagtagagactgcttcatgctgagagctggaacctggggcaccccactgtaaaataacatcacattcattccttctcttttctttccatgacggacgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358614 - DNA, 1407 bp, Homo sapiens
ggcccgaggggcacaggagaggtagcaaaggcccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358615 - DNA, 1630 bp, Homo sapiens
tccgtctcaaaaaaaaaaaaaaaaaaagaattgcctgtggagtttttcaacatacgtaagcctatactttgttggccctgttcattaatgggctccaccaggaaattaggaatctagttgagaaacagaagctgaatggaaaggccaccttatttgatatgttaaattatatgggaagcactgtcaaatcattagtgatgttaaaccttctctaagttatatttatgagtatgttattgatgtattccaaaagttatataagaaattctagaaatctaattggttatcagccataatgtcatatgccacagaagtaactaaatttctatgtgagttgtgttcttattataataaattatcatcagatttttaactgtactcattttaaatctttgtcattcacagacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358616 - DNA, 1222 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccagatggccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctgattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgag

SEQ ID NO: 358617 - DNA, 887 bp, Homo sapiens
cagctcggttcccccactagtgtcggcaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccagatggccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctgattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgag

SEQ ID NO: 358618 - DNA, 795 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcacattcataggatcctgcatcgttccttttgacgctgagcggacgcgtgggtccggacgcgtgggctagttc

SEQ ID NO: 358619 - DNA, 286 bp, Homo sapiens
atgaagagacctgctcaggacccaggaccccatttttccaccctaatgcataggtcccaatattgaccgatgctctctgctctctcctagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactca

SEQ ID NO: 358620 - DNA, 3454 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggattgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358621 - DNA, 3432 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgactgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358622 - DNA, 2609 bp, Homo sapiens
gcgttatgttcggagccacttatgttctgacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358623 - DNA, 2485 bp, Homo sapiens
  misc_feature (54)..(54): n is a, c, g, or t
aagcagtgcatcgtctcatggtatagctgttccagtgggctcagagtcttagcncagatcaccatgcaagatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358624 - DNA, 2444 bp, Homo sapiens
taaactgccagtcggacctgtcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358625 - DNA, 2508 bp, Homo sapiens
tcacagaggagtagagcggaagacaaatctcgtcgacccaggaaacctcaactggccacagcaggactacagtcaagacaatcacagtctctgcggcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358626 - DNA, 2950 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358627 - DNA, 1984 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatggcccagacgaccccaccatttcccccgtcctacacctattaccgtcaaggggtgaacctcagcctctcctgccattgggacacgcgggggatcctc

SEQ ID NO: 358628 - DNA, 2638 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358629 - DNA, 1580 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaatttgtccaccgggcgatcctctaatca

SEQ ID NO: 358630 - DNA, 1675 bp, Homo sapiens
tatctagaggatccttgatggagaggggtctcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagt

SEQ ID NO: 358631 - DNA, 1450 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttcccccgtcctacacctattaccgtcaaggggtgaacctcagcctctcctgccattgggacacgcgggggatcctc

SEQ ID NO: 358632 - DNA, 852 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtataccgtgagtgattcccccatgacctctgggtgttgggggtcagttctacttcccacacacaggattatcaggcctgggctgtgcctgtggccccctctgcattacgcaccatgttagggtttgggcatttagtgcaggatacacacagaagagacaaacttcaacagatcagaattcctttccggcatccagaccctgcagacactcactgcagaggaaggacagtctgatgtgggggacttagcagggggaggtcagtctcagccaagcaccccgtgccctccccgtaaacctgaccctgagaaagaccctggaga

SEQ ID NO: 358633 - DNA, 687 bp, Homo sapiens
gggctgatgctgaggcgactctaaggatcccttccgggttgtgcatccctggcagaggctctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcacattcataggatcctgcatcgttccttttgacgctgagcggacgcgtgggtccggacgcgtgggctagttc

SEQ ID NO: 358634 - DNA, 511 bp, Homo sapiens
agaggagagagctagctgcacacaacttcagggagaatttgtttccctgatgacgtaaccaggtacctagctagctgtgtcaaacttgctgatggccacattagcctaaatgtatgtctacagtaccataaaggaggtaccccaggccgggcgtggtggctcaagcctgtaatcccagcactttgggaggctgaggtgggtggatcacctgaggtcaggagttcgagaccagcctggacaacatggtgaaacccggtctctactaaaaatacaaaaaattagccaggtgtggtggtgggcacttataatcccagctactcaggaggctgagacagggaaatcgcttgaacccgggaggcagaggttgcagtgagctgagattgcgccactgccctccagcctgggtgacagagccagactctctctctcaaaaaaaaggaggtaccacaattccaagcaaacacttatctcacacattaccaccacaaataaaaatggaaatggctgtcat

SEQ ID NO: 358635 - DNA, 580 bp, Homo sapiens
ggacaagggcagttttgttgccgggttcctcccacgccttgtaaacttgaagaggcccttgcagggtaaatggtgctgtttgacttgagtgtttgcttgagggatttgtggggcttcccggccctctgcatgatttatctcagaggaaatgaggcagccctaggggagggggcgccatggttgagagcagcacacaggtgttttgtccatatgtgtgttttgctggggagggcctctgcctggcatccccatctctgggtttgggcagtccgagtgcaccttcttggattcttctaggctgtgtcaagaatgcccagaagaccctgacaaggcttggttggggaatctaagtagagggtgtttttgcatcttttttctttactaaaatagtgtgtattctttagttaaaatagaaaaaaaatcttcaaccaatgtgggcagccacccacctactcagatccagcctagctttgtggaaatgaccatcctctgtgtaaaccattgggatggatgtgtatccttgtagattttttttttaatgtcacatttaatacccatatagtttaatttttattccctg

SEQ ID NO: 358636 - DNA, 695 bp, Homo sapiens
ataaatcagtgtatatcaaatttaaaaatccctgcatagcaaagaaaacaatcaacagagtgaaagacaacactctgactaggagaaaatatttgctaactatgtatgtcataggcagttaatattcacaatataaagaagaactcttacacctcaatagcaattaacaaatgacaatttaaaatgggctaaggacttcaagagacattctccaaagaagacatacaaatgcagaaaaagtatattaaaaactgcttaacatctctagctgtgtgagtccattctcacattgctataaggaactacccgagactggataatttataatataaaggaggtttaattgactcacagttccataagctgtacaggaaccatggctagggaggcctcgggcttaatgatggaaggtgaaggggaagcagacacatcttcatgtggcagaacaagagaaagagagagtgaaaggaaaagtgctacaaacatttaaacaaccagatatcatgagaactcactcactatcatgagaacagcaagggggaaatctgctcccatgatccaatcacctctcaccaggtcccttccatagtgctggtgattacaattcgacatgagatttgggtgggaacacagagccaaagcttatcattccacctgtggtccttactctcatgtttttctcaagtttaaaaaca

SEQ ID NO: 358637 - DNA, 1291 bp, Homo sapiens
  misc_feature (1288)..(1288): n is a, c, g, or t
  misc_feature (1291)..(1291): n is a, c, g, or t
gccgccgctgccgctgccgccgccggcccggactcgtccggagcgcagggtgtctgcccagctgcgcgcggcgcgcggaggctccggcgtccgccgctgcgccctccggcccctgctcctcgcgccggcccgcgtgggtcccggcgggcgcgaacccaccatgcagctgcagttccggagctggatgctggccgcgctcacgctgctcgtggtcttcctcatcttcgcagacatctcagagatcgaagaagaaatcgggaattcgggaggcagaggtacaatcagatcagctgtgaacagcttacatagcaaatctaatagagctgaagttgtaataaacggctcctcatcaccagctgttgttgacagaagtaatgaaagcatcaagcacaacatccagccagcctcgtccaaatggagacataaccagacgctctctctgaggatcaggaagcagattttaaagttcttggatgctgaaaaggacatttctgtcctaaagggaaccctgaagcctggagatattattcattacatcttcgatcgagacagcaccatgaatgtgtcccagaacctctacgagctcctccccaggacttcgccactgaagaataagcactttgggacttgtgccatcgtgggcaactcgggggtcttgctgaacagcggctgtgggcaggagattgacgcccacagcttcgtcatcaggtgcaacctggccccagtacaggagtatgcccgggatgtggggctcaagacagacctggtaaccatgaacccctcggtcatccagcgggcctttgaggacttggtcaatgccacgtggcgggagaagctgctgcaacggctgcacagcctcaatggcagcatcctgtggatccctgccttcatggcccggggcggcaaggagcgtgttgagtgggtcaacgagcttatcctgaagcaccacgtcaacgtgcgcactgcatacccctcgctgcgcctgctgcacgccgttcgcggatactggctgaccaacaaagtccacatcaaaagacccaccaccggcctcttgatgtataccctggccacacgtttctgcaaacaaatctacctctacggcttctggccctttccgctggatcagaaccagaacccagtcaagtaccactattatgacagcctcaagtatggctacacctcccaggccagcccgcataccatgcccttggagtttaaggccctcaagagcctacatgagcagggggctttgaaactgactgtcggccagtgcgatggggccacgtanggn

SEQ ID NO: 358638 - DNA, 1423 bp, Homo sapiens
gccgccgctgccgctgccgccgccggcccggactcgtccggagcgcagggtgtctgcccagctgcgcgcggcgcgcggaggctccggcgtccgccgctgcgccctccggcccctgctcctcgcgccggcccgcgtgggtcccggcgggcgcgaacccaccatgcagctgcagttccggagctggatgctggccgcgctcacgctgctcgtggtcttcctcatcttcgcagacatctcagagatcgaagaagaaatcgggaattcgggaggcagaggtacaatcagatcagctgtgaacagcttacatagcaaatctaatagagctgaagttgtaataaacggctcctcatcaccagctgttgttgacagaagtaatgaaagcatcaagcacaacatccagccagcctcgtccaaatggagacataaccagacgctctctctgaggatcaggaagcagattttaaagttcttggatgctgaaaaggacatttctgtcctaaagggaaccctgaagcctggagatattattcattacatcttcgatcgagacagcaccatgaatgtgtcccagaacctctacgagctcctccccaggacttcgccactgaagaataagcactttgggacttgtgccatcgtgggcaactcgggggtcttgctgaacagcggctgtgggcaggagattgacgcccacagcttcgtcatcaggtgcaacctggccccagtacaggagtatgcccgggatgtggggctcaagacagacctggtaaccatgaacccctcggtcatccagcgggcctttgaggacttggtcaatgccacgtggcgggagaagctgctgcaacggctgcacagcctcaatggcagcatcctgtggatccctgccttcatggcccggggcggcaaggagcgtgttgagtgggtcaacgagcttatcctgaagcaccacgtcaacgtgcgcactgcatacccctcgctgcgcctgctgcacgccgttcgcggatactggctgaccaacaaagtccacatcaaaagacccaccaccggcctcttgatgtataccctggccacacgtttctgcaaacaaatctacctctacggcattcctgaccactagaactgtgcttggcacagagtaggcacttaataaactcctgctgcatgaacaaaagaacaagtgtggatgcttcaaaggaagacttgcacccggctgacccccagagtggggaaggggtcccacctaataggaagaacaccaagacttccccaagaggagaaggaacggctccccctttctcggcgaggccatgtgtctggaccctgtgtgagatgctttctatactagcccttgttggggtgttgcacccattttacagatcaaacaaccaagtttatcagaaattaaagactcatttaagatgcc

SEQ ID NO: 358639 - DNA, 1228 bp, Homo sapiens
  misc_feature (1225)..(1225): n is a, c, g, or t
  misc_feature (1228)..(1228): n is a, c, g, or t
gccgccgctgccgctgccgccgccggcccggactcgtccggagcgcagggtgtctgcccagctgcgcgcggcgcgcggaggctccggcgtccgccgctgcgccctccggcccctgctcctcgcgccggcccgcgtgggtcccggcgggcgcgaacccaccatgcagctgcagttccggagctggatgctggccgcgctcacgctgctcgtggtcttcctcatcttcgcagacatctcagagatcgaagaagaaatcggagctgaagttgtaataaacggctcctcatcaccagctgttgttgacagaagtaatgaaagcatcaagcacaacatccagccagcctcgtccaaatggagacataaccagacgctctctctgaggatcaggaagcagattttaaagttcttggatgctgaaaaggacatttctgtcctaaagggaaccctgaagcctggagatattattcattacatcttcgatcgagacagcaccatgaatgtgtcccagaacctctacgagctcctccccaggacttcgccactgaagaataagcactttgggacttgtgccatcgtgggcaactcgggggtcttgctgaacagcggctgtgggcaggagattgacgcccacagcttcgtcatcaggtgcaacctggccccagtacaggagtatgcccgggatgtggggctcaagacagacctggtaaccatgaacccctcggtcatccagcgggcctttgaggacttggtcaatgccacgtggcgggagaagctgctgcaacggctgcacagcctcaatggcagcatcctgtggatccctgccttcatggcccggggcggcaaggagcgtgttgagtgggtcaacgagcttatcctgaagcaccacgtcaacgtgcgcactgcatacccctcgctgcgcctgctgcacgccgttcgcggatactggctgaccaacaaagtccacatcaaaagacccaccaccggcctcttgatgtataccctggccacacgtttctgcaaacaaatctacctctacggcttctggccctttccgctggatcagaaccagaacccagtcaagtaccactattatgacagcctcaagtatggctacacctcccaggccagcccgcataccatgcccttggagtttaaggccctcaagagcctacatgagcagggggctttgaaactgactgtcggccagtgcgatggggccacgtanggn

SEQ ID NO: 358640 - DNA, 396 bp, Homo sapiens
ctcagtgcatagttagagaaattgaggcacagagagagagggacagggccaaagctgagctcagagagcaccccagggagctgggccagaatcccatggcaacacatgcagggaaagagcttctttctctctctctcagcaggcacccatgctgccttatttttttttttttttttttgagatggagtctctctctgttgccagactggagtgcagtggcatgatcttggctcactgcaacctccaactccctggttcaagcaattcttctacctcagccttccgagtagctgggattacaggcacgcaccaccacaaccggctaatttttgtatttttagtagagacagggtttccccatgttatccaggagggtctcaatctcctgacctcgtg

SEQ ID NO: 358641 - DNA, 1734 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358642 - DNA, 1773 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaataaaaaaaaaagtcgacgcggccgcgaatttagtagtagta

SEQ ID NO: 358643 - DNA, 1328 bp, Homo sapiens
cgccagggggagtccgagcgaagtcctagccagcgagtcagaggggaggggagcagggaggggccgagggtggggaggtgagggagtggggaatggggcgggcgacaacccttcagtgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358644 - DNA, 1730 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagacgctacttcgttgttgaagggttattcatgataggcatatgggcccctccttcaggatcaggtcaggccttgcgccctcggtcgccacgctcacgtacggtccgtgggctctttggggtcgctggggttgg

SEQ ID NO: 358645 - DNA, 1694 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358646 - DNA, 1698 bp, Homo sapiens
atcccccgaacatgtcctggctgggtactctatacaaaaattagctggttatggtggcaaatgcctgtaatcccagctactcaggaggctcaggtggaaggattgcttgaggtgggaggttgaggctgcagcgagccatgatcatgccactgtactcagcctggatgacagaatgagacgctgcttgagaggggaaaaaaaagacacctgcttgggatgattaaagttctgtcttgactggtagttatttgaattaggtccctccagtgcttttaatcatggtagaatgtgctagcaagtgagtttgtcttacatggaagagttctgtgttcaagggctttcggccagtggcattcctaaacacagtgttaaaggcggtagggaatgtgaaaagtatgacatagttcctgctctcaacagcttgtaattttagtattattatcgtaagctcaattgtaggtactacttcttttctggactttcaggtgcttattaccgtgcaatttagtggtatgagttgaggactaatgtttctatatcacatcctgataatctccacagttatgaaaactaaactatttcccctccctcctacacttttccccaactttattttaatggaattgtttggatttcttgattgttttgtaatagttgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358647 - DNA, 1680 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358648 - DNA, 2650 bp, Homo sapiens
  misc_feature (1033)..(1033): n is a, c, g, or t
  misc_feature (1037)..(1037): n is a, c, g, or t
  misc_feature (1042)..(1042): n is a, c, g, or t
gtgtcctttctatcaaagaaaaggacaaaagataaacgttcaaaattggaatttatttttcttttggcaaatgttaaatctcacctctaatgagaaatcatagctaattaggagataacttacatgtaagcatttagattcagtgccattagaagtgctgggtgggtgatatctgcaggagaaaaaaatgatgctagtttaaaaaatctctactattaccgtgaaatatttttaaatgaaaactttcgtcctctaaatatgactgtggaaaagaaaatgagtatatttaataacatcttttgacatctctagtagtaacagtaggtcatcttattcataaaccaaaattttaccaaatttcaggccaggcgcagtggctcacgcctgtaatcccagaactttgggaggccgaggcgggcggatcacctgaggtcaggagttagagactagcctcgccaacatggcaaaatcccatctctagtaaaaatacaaaaattagccaggcgtgggggcccgtgcctgtaatcctagccacttgggaggctgagacaggagaatcgcttgaacccagcgggcagaggttgcagtgagccgagatcgcgccattgcactccagcctggatgacagaacaagactttgtctcaaaaaaaaaaaaaaaaaattaatcaaatttcaaaaccaggttttgtagtacatttaaattgcatattccaaagcagttgggtttgcctgcgttgcagtttaatattaagctatacttccctttcaaataaggtattttcatcgttaagcctgtaaattctagtttgtcattgtttagatatttatagtcattttaatatatctgtttacggccagctgcaatggctaacacctgtaaactcagcactttttgaggccaaggtgggccgattgagctcaggagttcgagaccagcctgggcaacatagtgaaactccatctatacaaaaaatccaaaaaaaaaaagacaggtgtggtggcatgtgcctgtagtcccagctatcccggagngggncgggnggatggcttgagcttgggaggtcgagggtgcagtgagctgtgattgtgccactgcactccggcctaggtgacagaatgagacgctgcttgagaggggaaaaaaaagacacctgcttgggatgattaaagttctgtcttgactggtagttatttgaattaggtccctccagtgcttttaatcatggtagaatgtgctagcaagtgagtttgtcttacatggaagagttctgtgttcaagggctttcggccagtggcattcctaaacacagtgttaaaggcggtagggaatgtgaaaagtatgacatagttcctgctctcaacagcttgtaattttagtattattatcgtaagctcaattgtaggtactacttcttttctggactttcaggtgcttattaccgtgcaatttagtggtatgagttgaggactaatgtttctatatcacatcctgataatctccacagttatgaaaactaaactatttcccctccctcctacacttttccccaactttattttaatggaattgtttggatttcttgattgttttgtaatagtgggacacagcaggccaggaagagattttcgaacaatcacctccagttattacaagaggagccccatggcatcatagttgtgtatgatgtgacagatcaggagtgagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358649 - DNA, 2239 bp, Homo sapiens
  misc_feature (1033)..(1033): n is a, c, g, or t
  misc_feature (1037)..(1037): n is a, c, g, or t
  misc_feature (1042)..(1042): n is a, c, g, or t
gtgtcctttctatcaaagaaaaggacaaaagataaacgttcaaaattggaatttatttttcttttggcaaatgttaaatctcacctctaatgagaaatcatagctaattaggagataacttacatgtaagcatttagattcagtgccattagaagtgctgggtgggtgatatctgcaggagaaaaaaatgatgctagtttaaaaaatctctactattaccgtgaaatatttttaaatgaaaactttcgtcctctaaatatgactgtggaaaagaaaatgagtatatttaataacatcttttgacatctctagtagtaacagtaggtcatcttattcataaaccaaaattttaccaaatttcaggccaggcgcagtggctcacgcctgtaatcccagaactttgggaggccgaggcgggcggatcacctgaggtcaggagttagagactagcctcgccaacatggcaaaatcccatctctagtaaaaatacaaaaattagccaggcgtgggggcccgtgcctgtaatcctagccacttgggaggctgagacaggagaatcgcttgaacccagcgggcagaggttgcagtgagccgagatcgcgccattgcactccagcctggatgacagaacaagactttgtctcaaaaaaaaaaaaaaaaaattaatcaaatttcaaaaccaggttttgtagtacatttaaattgcatattccaaagcagttgggtttgcctgcgttgcagtttaatattaagctatacttccctttcaaataaggtattttcatcgttaagcctgtaaattctagtttgtcattgtttagatatttatagtcattttaatatatctgtttacggccagctgcaatggctaacacctgtaaactcagcactttttgaggccaaggtgggccgattgagctcaggagttcgagaccagcctgggcaacatagtgaaactccatctatacaaaaaatccaaaaaaaaaaagacaggtgtggtggcatgtgcctgtagtcccagctatcccggagngggncgggnggatggcttgagcttgggaggtcgagggtgcagtgagctgtgattgtgccactgcactccggcctaggtgacagagcaagaccctgtctcaaaaaaaaaaatctcttcactccttagcagtggttattttgtagctagagttgtctcactagctctttgttatttgtctgttaggtcaggaacgatgtttctgtttattccagaactatattatcgaactatattatcagtctttcaaatgtctttttaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358650 - DNA, 2105 bp, Homo sapiens
  misc_feature (488)..(488): n is a, c, g, or t
  misc_feature (492)..(492): n is a, c, g, or t
  misc_feature (497)..(497): n is a, c, g, or t
attggaggtaaaggtctctatctagcgccctcacctcatggggttctcttttaatatcaggactatgggagtctcagaatttattccattctaatggaccacaggagatctgccattaaactgaccgcagggagccactgtctctacctctgctcctccctccatgtctttgctctgtgcagaccacaggggtaactacctcaacatctgggaagctgtgagtttcccaagcaactcatttgctttcccctcttggctaccgagctggtgttcttgatgtttgtttagcagttaagaagtgtaaagtcggccagctgcaatggctaacacctgtaaactcagcactttttgaggccaaggtgggccgattgagctcaggagttcgagaccagcctgggcaacatagtgaaactccatctatacaaaaaatccaaaaaaaaaaagacaggtgtggtggcatgtgcctgtagtcccagctatcccggagngggncgggnggatggcttgagcttgggaggtcgagggtgcagtgagctgtgattgtgccactgcactccggcctaggtgacagaatgagacgctgcttgagaggggaaaaaaaagacacctgcttgggatgattaaagttctgtcttgactggtagttatttgaattaggtccctccagtgcttttaatcatggtagaatgtgctagcaagtgagtttgtcttacatggaagagttctgtgttcaagggctttcggccagtggcattcctaaacacagtgttaaaggcggtagggaatgtgaaaagtatgacatagttcctgctctcaacagcttgtaattttagtattattatcgtaagctcaattgtaggtactacttcttttctggactttcaggtgcttattaccgtgcaatttagtggtatgagttgaggactaatgtttctatatcacatcctgataatctccacagttatgaaaactaaactatttcccctccctcctacacttttccccaactttattttaatggaattgtttggatttcttgattgttttgtaatagtgggacacagcaggccaggaagagattttcgaacaatcacctccagttattacaagaggagccccatggcatcatagttgtgtatgatgtgacagatcaggagtgagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358651 - DNA, 1578 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatagtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358652 - DNA, 2487 bp, Homo sapiens
  misc_feature (1033)..(1033): n is a, c, g, or t
  misc_feature (1037)..(1037): n is a, c, g, or t
  misc_feature (1042)..(1042): n is a, c, g, or t
gtgtcctttctatcaaagaaaaggacaaaagataaacgttcaaaattggaatttatttttcttttggcaaatgttaaatctcacctctaatgagaaatcatagctaattaggagataacttacatgtaagcatttagattcagtgccattagaagtgctgggtgggtgatatctgcaggagaaaaaaatgatgctagtttaaaaaatctctactattaccgtgaaatatttttaaatgaaaactttcgtcctctaaatatgactgtggaaaagaaaatgagtatatttaataacatcttttgacatctctagtagtaacagtaggtcatcttattcataaaccaaaattttaccaaatttcaggccaggcgcagtggctcacgcctgtaatcccagaactttgggaggccgaggcgggcggatcacctgaggtcaggagttagagactagcctcgccaacatggcaaaatcccatctctagtaaaaatacaaaaattagccaggcgtgggggcccgtgcctgtaatcctagccacttgggaggctgagacaggagaatcgcttgaacccagcgggcagaggttgcagtgagccgagatcgcgccattgcactccagcctggatgacagaacaagactttgtctcaaaaaaaaaaaaaaaaaattaatcaaatttcaaaaccaggttttgtagtacatttaaattgcatattccaaagcagttgggtttgcctgcgttgcagtttaatattaagctatacttccctttcaaataaggtattttcatcgttaagcctgtaaattctagtttgtcattgtttagatatttatagtcattttaatatatctgtttacggccagctgcaatggctaacacctgtaaactcagcactttttgaggccaaggtgggccgattgagctcaggagttcgagaccagcctgggcaacatagtgaaactccatctatacaaaaaatccaaaaaaaaaaagacaggtgtggtggcatgtgcctgtagtcccagctatcccggagngggncgggnggatggcttgagcttgggaggtcgagggtgcagtgagctgtgattgtgccactgcactccggcctaggtgacagagcaagaccctgtctcaaaaaaaaaaatctcttcactccttagcagtggttattttgtagctagagttgtctcactagctctttgttatttgtctgttaggtcaggaacgatgtttctgtttattccagaactatattatcgaactatattatcagtctttcaaatgtctttttaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggtatgtttaaagtttaattttcatactgaatttgaaggtgttgaattatgtatgggttctgcagtaacagtaaggccacagccttttaaaaatatgtgcactagaatactgtgacagtgacaatttgtgtagcatctgtttggatccaatgaacttagttcctcacgctccattatggatggtagaaatgcactaagaattagtgaaaaagatttttcagtgttaattgtgcctcattattctcttaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358653 - DNA, 1179 bp, Homo sapiens
  misc_feature (12)..(12): n is a, c, g, or t
ggtctagagganccttatgtctcgatcgttatgccagtgaaaatgtcaacaaattgttggtagggaacaaatgtgatctgaccacaaagaaagtagtagactacacaacagcgaaggtatgtttaaagtttaattttcatactgaatttgaaggtgttgaattatgtatgggttctgcagtaacagtaaggccacagccttttaaaaatatgtgcactagaatactgtgacagtgacaatttgtgtagcatctgtttggatccaatgaacttagttcctcacgctccattatggatggtagaaatgcactaagaattagtgaaaaagatttttcagtgttaattgtgcctcattattctcttaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358654 - DNA, 1360 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggtaagttccaagaggagattgtgttacagtgaccaagtaggaagccattatttgattaatgtcagattcatttactacttcatatataagccatcagtattaattttatggcagaaaactttgtccactctcaaatataaatgtgaatcacttaaaagacatttgttttcctgtaataaataaaagattagtaattagttttacgtttgctttcaagggattctggttgtatttattgtcaactaaataactttgatcaaatagccaagactctaacatataggcaagagtttgtagggaatcgtgagttgcttggcttatactgtgttcttggtgttaagtattaacaggaatatggcctggtaattagaacttgtccatcagaattgccaaaagtggggattcgggggtctctgcctatggaggatgtggttcagaaataaagaatttgaatagggataagctgtagggaggatcttagtatgaggattgagtatcctgaagattagctgtgaggagaggggcagagcgatgggagggaacaatgtgggacagtgtgaagcatgtgatcca

SEQ ID NO: 358655 - DNA, 1171 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagatgcaacggtcatccgactcccctatcccctgaccaagacgctaactccatctacgacgctcacacctgcgtgcgcctcctcaacacgccgaaccgcgcccgatccaccgtccgggtggcccccaatcggccggccccgccgcaccccgcccccgcgcgccaccccgccaacgcaccgacccccaccaccccgccccccccccgcccccgaaccaaccacccacgccaccccaccccacgccccccccac

SEQ ID NO: 358656 - DNA, 1324 bp, Homo sapiens
atcccccgaacatgtcctggctgggtactctatacaaaaattagctggttatggtggcaaatgcctgtaatcccagctactcaggaggctcaggtggaaggattgcttgaggtgggaggttgaggctgcagcgagccatgatcatgccactgtactcagcctggatgacagaatgagacgctgcttgagaggggaaaaaaaagacacctgcttgggatgattaaagttctgtcttgactggtagttatttgaattaggtccctccagtgcttttaatcatggtagaatgtgctagcaagtgagtttgtcttacatggaagagttctgtgttcaagggctttcggccagtggcattcctaaacacagtgttaaaggcggtagggaatgtgaaaagtatgacatagttcctgctctcaacagcttgtaattttagtattattatcgtaagctcaattgtaggtactacttcttttctggactttcaggtgcttattaccgtgcaatttagtggtatgagttgaggactaatgtttctatatcacatcctgataatctccacagttatgaaaactaaactatttcccctccctcctacacttttccccaactttattttaatggaattgtttggatttcttgattgttttgtaatagttgggacacagcaggccaggaaagatttcgaacaatcacctccagttattacagaggagcccatggcatcatagttgtgtatgatgtgacagatcaggtaagttccaagaggagattgtgttacagtgaccaagtaggaagccattatttgattaatgtcagattcatttactacttcatatataagccatcagtattaattttatggcagaaaactttgtccactctcaaatataaatgtgaatcacttaaaagacatttgttttcctgtaataaataaaagattagtaattagttttacgtttgctttcaagggattctggttgtatttattgtcaactaaataactttgatcaaatagccaagactctaacatataggcaagagtttgtagggaatcgtgagttgcttggcttatactgtgttcttggtgttaagtattaacaggaatatggcctggtaattagaacttgtccatcagaattgccaaaagtggggattcgggggtctctgcctatggaggatgtggttcagaaataaagaatttgaatagggataagctgtagggaggatcttagtatgaggattgagtatcctgaagattagctgtgaggagaggggcagagcgatgggagggaacaatgtgggacagtgtgaagcatgtgatcca

SEQ ID NO: 358657 - DNA, 1101 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagtatccagggtgtgagcaagcagaactcagacagctctgtcatgctgaagctggaatacagtcccttacctctgagaagcgtctcctggcagatgaaaccctcaatcactctgtcgctaacaggacacgtccaaacccaggaggtcgccccagaccccatcctgctcagttcacacgccagtggtaactgaacactagcagaatgactggttcatctcagcttcttcactgaattttttatctgcttgatgaagaactcacccccgagggaagcaggacagcacagtgttgaaggacatgggttttggagccagacaaacctgaggccagcccctaactttgccaccttccagatgtatgacttcgagcctcactttcctcccctcatagcaccagctcctcagaaggtaaggattaaatacacccatgtgtgcaaagcacatggtaagagcttaacgaacaacaggaattctaataataagcaccggactcatccccgtgaaagg

SEQ ID NO: 358658 - DNA, 582 bp, Homo sapiens
aaactattacagcataaactattacagcataaactattacagcataaactattacagcataaactattacagcataaactattacagcataaactatttcccctccctcctacacttttccccaactttattttaatggaattgtttggatttcttgattgttttgtaatagttgggacacagcaggccaggaaagatttcgaacaatcacctccagttattacagaggagcccatggcatcatagttgtgtatgatgtgacagatcaggtaagttccaagaggagattgtgttacagtgaccaagtaggaagccattatttgattaatgtcagattcatttactacttcatatataagccatcagtattaattttatggcagaaaactttgtccactctcaaatataaatgtgaatcacttaaaagacatttgttttcctgtaataaataaaagattagtaattagtttatgctgtagcataaactagtttatgctgtaatagtttatgctgtaatagtttatgctgtaatagtttatgctgtaatagtttatgctgtaatagtttatgctgtaatagttt

SEQ ID NO: 358659 - DNA, 2759 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaatatcaaactgtatggtgataagtattgttttgattcttatggttaaagggaaatagagccttgcattatattcaacacagccatttgtgtgtgcacaatgcaaactaaggtattctagacctatcttagagcagcatccagtatttgctttctagataatatgcccaataacatgacctagaggggcttctgtgctgtgtagggatttaaccaacttcagtggttcagggagctcaaactatatgtaaaacaagtttagaatgtatgctatctagcccgttatctctgatccttctctaaaaccatttgaaatagcttcattgatcaacatttcataaatgcatctgtggtagaggtagaaagcagcacctttcctaattggcaaatgatcagactaatgtgtgctaatgtttttcttccatgctttcagtcagattcaactattttatcctccacagttgcttaacttggtgttggaggagggtttaagcattaagataggaagcaggaaatttgattgctctaaatttagaaattatatccctaaaaattaaaacatgaatactgggtggtaatgataattgaggcaaatgtatttattttggtgacattttgcatatatgaagattttctgaaataggaccttcaagatcctagggggttttgtttggtttttaattgtgaggaataaaaaatcttctgcccacactggcattttaaggtgactgaggtcaaacgttgtttccttaggttgaaatagcagccaaaacattcttcacgcaggggcttgggatatggctgctggcaacacattttgttgtgggctccttaatttaatgataaaatttaagctaaacacaagccaaaaatgaataggtttttttaatttttatttttcactaaacaggcaattgaaatacatggtacaaaaataagtggtaagataattgtaaaatgaaatggacagaatattcaattttccatctatgaaaatttcacaataaaaatcatagtttactttgtatta

SEQ ID NO: 358660 - DNA, 1701 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358661 - DNA, 1681 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaacgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358662 - DNA, 1982 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggtatgtttaaagtttaattttcatactgaatttgaaggtgttgaattatgtatgggttctgcagtaacagtaaggccacagccttttaaaaatatgtgcactagaatactgtgacagtgacaatttgtgtagcatctgtttggatccaatgaacttagttcctcacgctccattatggatggtagaaatgcactaagaattagtgaaaaagatttttcagtgttaattgtgcctcattattctcttaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358663 - DNA, 1542 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358664 - DNA, 1506 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatagaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaata

SEQ ID NO: 358665 - DNA, 1254 bp, Homo sapiens
cgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggtatgtttaaagtttaattttcatactgaatttgaaggtgttgaattatgtatgggttctgcagtaacagtaaggccacagccttttaaaaatatgtgcactagaatactgtgacagtgacaatttgtgtagcatctgtttggatccaatgaacttagttcctcacgctccattatggatggtagaaatgcactaagaattagtgaaaaagatttttcagtgttaattgtgcctcattattctcttaggaatttgctgattcccttggaattccgtttttggaaaccagtgctaagaatgcaacgatcgagacataggtccggctcgattctata

SEQ ID NO: 358666 - DNA, 773 bp, Homo sapiens
agaagaaatttagagagtatcttggattcttgtcagtaagatttgttgtatcaacttagaaacactttcattttagcccatattatacaatcaatttctgtaatttttatgtttacttatgtattaagccttgaagattcagtttaaggagatttatttttttctttttactgaacatgaagttacttcataagtgccttgattggatgattggaactattagtaatttacccctcaaattatatctaataatctaagcattcattgtgctttcctaaaaacaatcaagtcctgatcttttctggatcatttgaacttaaatggagaaaaggcagagcatctatgtattatgagtcactgccaatcaaagatatcagaaatacttctctaaaattaatgtcatatttaatatatgataatttgcttctataattcctttcaggagcatacctattgaataaaatatagtgtatgtgtattgatttttgataatgtatacacatatttcagttgttttgaatctacctttataaaaagcttttggtactattttattacagttattactttttaatttttttttttttaagatgcaggatcttgctgtgttgtccaggctggtatcaaactcctgggctcaagtgatcctcctggatagctgggattatatgcatccgccaccatacctggctaagttttgtatttttagtagagacggggtttcagcatgttggccaggctggtttcaaactcctgacctcaggtgatctgcc

SEQ ID NO: 358667 - DNA, 4837 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtaagttaagactgctgttcaggaatttgggaagctggctccagaaaagaagtggaaatgaaggggtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataattgattacttctgtctaaaagagctaagcatttaatttatttattttcttcctccttcaggggcagtttaaaccttagcatcagagcaaggcccagggagaagctgaagctttagattagtatttttgctaatggcctcttttgaaaaggattttataaatgcaataattccttccctctcataattgtgcagggcagatagataggacatatggaacatacgtggcagaatgacattggtaatcaaagtgagtgagacaggaacccaaggaggtgttcccacagtaaggaaagccctagattccaagagcaacactttatgctattcctctaatgtataaaatacaggaaaaaaaaatgctaagggcttaaaagatgtctgcttagtagttccaagctac

SEQ ID NO: 358668 - DNA, 4630 bp, Homo sapiens
  misc_feature (4445)..(4445): n is a, c, g, or t
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtaagttaagactgctgttcaggaatttgggaagctggctccagaaaagaagtggaaatgaaggggtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataatcgtaaaanaaaagaaaaaaacaaaaaccaaaaacttttgtttgggcggcgcatgaggccctgagaaaaagtttttaaacccctccgttgggggcccggggccccagtggtttacggacaccgggcacacgcggtgccccaaggaaaaccccggggaaacaaggcggctggctttttcaccaaataaaaaaggg

SEQ ID NO: 358669 - DNA, 4610 bp, Homo sapiens
catttataaacaattttcactccaatatgtagaataactttcatgatgggctttattagagggtagtgaattctttgtagattgaaaaaccatttggacattgtctagtctgtgaagatgtttcgggcattcagttagtggttagatttaaggaatttctccttctaaaattctaattacagttccccaaacacattgtctctgattcactgatgtattaccattgcctagaatagtgtctggcattagtaggcattcagaaaatgtttgttgagtaaatgaatgtttctatgtttatagttttccctcttccttgacattcttgccctgatagattgccttgtaaaatttgattcatctttatgagctcagttcatatgtcatccctgtttcacagaggatttatgcctttctggagtctcttaggcaaaattgtttccttctgtatttccatagcaccttgctaattctgcattctgttacactgtctaaaattaataattgtgtaaaactcttctacaagagattaactccttttgggcagtgacacaatgataatgctattcatttttatagtttttttttttaagcctactcccttggatatagtaacattcagtgagtgtttgattttagtttgattaggtatttaatgagtgaggaccaaattgtgagaagtaaatccacatgtagttagaccatttttctccataatagtggaatgagtaacactattgtatcttaaatcagaggaatatagaataaaataaagttcaaaacatagtaaaagggggatgtcttttatattgaaagtagaagttgatgttcactttttacgggctcagaatgtcttactgaagaggtagcatttgagatagttccttcccagattggttaggtatttatctaacaagtagaaagcaaaaagtggaaagtacattctaagaacaaaaagtacaagctacagtggtgggagattggcaaataggaagttatgtgtgaccatggtataggaaccaaaaaacaattggtagtatgagacaggaaatgtagacttgagtcctgtggtaaacgacttcagttgcagaatgagaaatttgtaggcagtagagaggtgttttttttttgtttggtttttcttaatgtagggcacagctgctgttgaaactgatgtatccagattagagtggtggagtaggacataattatattagttgggctgttgtttaagaaaagtcgataagagggcctgagttagggtaatggcaacaagaaaagattaagagaggtttggaaagatatttactgaacagaaacatctttttttatataaacataaataaggatagtgtggggatatgtttgcagatacgattttcatgaattttaataaaaattgattaatagttaattatataaaatactgtcttaatgtcttccctttagggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358670 - DNA, 3811 bp, Homo sapiens
gtaaaatttaaatacttaggttattgtatgctctatgtcttgactatgatgccttttataataatttctaaaggcttaatttaagaatacagaatataaaatacatagcaacctagtttgataggctgttagctcaaatagagttgagaacactaagtccttcttttctttcagttcttgatggtgctatccactcattcttatcacccaatcttatattctgactttcagcaaagtaagagtcaatatcttgattttatttgaggagagaatttatcagatgttataggaaaattcagaaatgaattcattaattttttcagggaagttctggagtaggctctatctgtactactcctccttccccttaccccacaaaaagaaaaaaaaagacctataacagtctgttattatcaggattaaaaattgttgccatttttgtattggtaatgaaaattgtagtttatatttgatagtttctagttttactatctttagttgaaattaagtataatatgtatataaaatgtattaaaatgtaataagaatgagatgatttgattaattgcatttattttatcactttgaattaaatttactatattggttgtttaattttgatcatatgataacagcaaaaaggactttatttatatatctaatttattctctttttaagatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358671 - DNA, 3028 bp, Homo sapiens
gaagacttagtagaagagtgggcccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358672 - DNA, 4687 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagaggtattaaattatttatcagtcttgtttttgttggaattaacagaaacatttaacatttaataaaagatccattaaggtaaacatagtaattcatagcttagtagcacaatgatgccagagattttaaaccttgttttatactgtaattttggtagaaataagtagactacgaattcattctattttaaataaatttattcaatgggacatcattttaaatataagaacttgtgaaagaccatatttcctgttagtctcatggagcatgcttataatgctacgtactttaaacaatcttttaaaatgtcattttagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358673 - DNA, 2894 bp, Homo sapiens
caatataagagggaatggtctaagggcatccaaactaacaattacttagaaaaataagctgtggaactcttttatagaaatagaatcttccagataagtattatataacatacgggattttaatttgagtagtgacagttgtttacttatattaataaagaattttcttcttaacttcattttctctttatcattgttttatggtagaaaaggtgtatttcattatttctccaggaatatactgggagaaataacttgtaaaataaaattgcattgtttttatcttttaggtgggaagaattattttaaatgtctgaatgttttaagtatgtcatatacaaatatataaccaaagctcacattttctgaaaaaaaaggggaaaataagtcattatttttggctttgtatcttagagtaattgcttttgaaatgtagtgcaattctagaaatctggggtaatatatatatatatatttttttttttttaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358674 - DNA, 4460 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttactgaattcaaactatttacttgtaaacatttaacaagcattatgagatctaaatacagtctttgacatttcaacaaataagtcgtatgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358675 - DNA, 2629 bp, Homo sapiens
tattgaatttgtgatgttactgaaaactcctttaatgaaaagcatttaacaccatagggaagactgaacaccaggaaaatttacttgcatgactaattatcgtgttctctttttaaacaataattgcttgtttttcttcccaagtatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagaggtattaaattatttatcagtcttgtttttgttggaattaacagaaacatttaacatttaataaaagatccattaaggtaaacatagtaattcatagcttagtagcacaatgatgccagagattttaaaccttgttttatactgtaattttggtagaaataagtagactacgaattcattctattttaaataaatttattcaatgggacatcattttaaatataagaacttgtgaaagaccatatttcctgttagtctcatggagcatgcttataatgctacgtactttaaacaatcttttaaaatgtcattttagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358676 - DNA, 3601 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggaacccacgccgtgggttccttgcagatctgtgaccttacccccaaccctgtgctctctgaaacatgtgctgtgtccactcagggttgaatggattaagggcggtgcaagatgtgcttgttaaacagatgcttgaacgcagtatgctcgttaagagtcatcaccagtccctaatctcaagtacccagggacacaaaaacagcggaaggccgcagggtcctctgcaaggaacccacgcggg

SEQ ID NO: 358677 - DNA, 2324 bp, Homo sapiens
gaattctggttaacatttttatcttgttacattaaatttttgagactctgcatcatattacaaaagatctcagcagacagaaataacgggccccgactaaaatgatgtacatttaatactgaaaaacatcaggttttgctcttgagtctgaatgttaattctactggaaaacagtgtaataacactttggtagcatgtgtgaaaatggctagttagtaagtcaatattgattttatttttttttctttcagtttctgtcttgtcttttctctgtcacatacagatatagtgcatggccaaagtgattctcaaactgtgaaacaaatgattattatttgggatgtttgtcaaatttcacatccagaggttctgaagtgtggccttgaaagctgcacgtctaacaaactcttagaggaatttataggtattccgatgcaagtgaaccatggcctacactttgagaaacagtagactacattgatagacttctatctgccatctgcaccaaacagatacagataaggatgtattcaaagaccagaccagaatttgaagggacttaataccaggtcaattaagatattggagatatagaacaaaatgagttacactttgaatgtcctcagctgacataagggctactgagaggaagtgaccacagggacagttttgactagtttctaatgtagtttcaggagatagtgaatgctgtcaccgcactggctaaccatttggcagggattttgtagaagggattaaagcattgagtttggtgactgagttctctacaacctgagattctagaatcctcaagtcctgtttctccccgcccctccccccgcagctttcaaaactaataatatgacttgacttgccttagatattaaataaaaaaagccttttttaaaagagagataaactgcttctgacaacatgtgatagtgtgatagttctggcctaaaaaataggagcatgccaaacacaaacaaatttctgttcactttagggtataaaaattctcttagttatgaccagaaatactcagccaatgactgaataatagagacttatgttttgaggggaattgtggtaatattttatgcatccttttgctttgatacagtttttttcaaatccaggttcccatcctgaaattgctgaccgagctttcatttattttcataccatttttcctctgtctagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358678 - DNA, 4112 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttggggtatgtatatagttttcaggtactttttttaagacttctagttgatatagctgagttaacccatttaagcagcaatctttagaaagattttctatccaaaactaaaaagacaaaaagcctgcaaatttttgtctgccttcctaaacaaaaaacatatttttgtttgtaattaaaaccatttattcttacactaaatagtttacaccaaagcatacattattgtggcttttagactacttccatcattttttagggtctgtcttgcttttcatatccttttaaagctatcacatctgactgccatgacattctgttgcctccttagcttttttactttgctgctactatgtggggcgtgaagcaagacgatgacacagttctgaccaggttaaataagtagactgaaaagtcttcttttctaggaataaaagacgtggattcggtgttacacttcattcagtgtgaatatctgtgcctcatttgggccttgttaataaaataaattgtgattacaaaattacgaatgagggtattttataatttctaggaccctgcctttcttaatcaagttaaattttcatgattgaacagattttcaggtactgagtcagttttaaactaaacttattagtaattcagttcatatacagagaaaccaggaaggtgcatgtacatgtgaatagagccaggtgtaaggcatggcattagggagtgctaggattggagattgaggtgtccatgttctgtcttaatgtattcagattcagttaaaaagaccaccacaatttgtggcaaacaaatcaggaatgccgttgagtcactagtttgcaacctcaggtataaaaactagtgtatgaaaaattatggcatagctccatatttatagtgaaatttatagtgaaatggacaaaaatgctaaaagtccatcatgcttctatatgtgaactgggatatagttggtcaatcattggaaaatattttactataatgtttaag

SEQ ID NO: 358679 - DNA, 3787 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggcttttttactttgctgctactatgtggggcgtgaagcaagacgatgacacagttctgaccaggttaaataagtagactgaaaagtcttcttttctaggaataaaagacgtggattcggtgttacacttcattcagtgtgaatatctgtgcctcatttgggccttgttaataaaataaattgtgattacaaaattacgaatgagggtattttataatttctaggaccctgcctttcttaatcaagttaaattttcatgattgaacagattttcaggtactgagtcagttttaaactaaacttattagtaattcagttcatatacagagaaaccaggaaggtgcatgtacatgtgaatagagccaggtgtaaggcatggcattagggagtgctaggattggagattgaggtgtccatgttctgtcttaatgtattcagattcagttaaaaagaccaccacaatttgtggcaaacaaatcaggaatgccgttgagtcactagtttgcaacctcaggtataaaaactagtgtatgaaaaattatggcatagctccatatttatagtgaaatttatagtgaaatggacaaaaatgctaaaagtccatcatgcttctatatgtgaactgggatatagttggtcaatcattggaaaatattttactataatgtttaag

SEQ ID NO: 358680 - DNA, 3221 bp, Homo sapiens
  misc_feature (3154)..(3154): n is a, c, g, or t
  misc_feature (3182)..(3182): n is a, c, g, or t
  misc_feature (3188)..(3188): n is a, c, g, or t
  misc_feature (3213)..(3213): n is a, c, g, or t
  misc_feature (3220)..(3220): n is a, c, g, or t
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccgggcactacaggggcaatccnagaacgggggccctggtccccggtggantttaancaaggcaattggccaatggaggaantttgcgnt

SEQ ID NO: 358681 - DNA, 1213 bp, Homo sapiens
cgtgggttccttgcagaccactaatttttttctcgcgtgggttccttgcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358682 - DNA, 1084 bp, Homo sapiens
agttatacactagttgtcactaagaatgtgtatcttgtcagttagttcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358683 - DNA, 838 bp, Homo sapiens
acttggctgttttttatttaggatcctaaaatgtaaactgactccactaccgaccttgtatctaggtaggtttccagcttcaaaatgggatacatactatggcagaactggaagagacctcagaatcaccatagtgaaccggctcaaaactataaacagacacaggagtatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358684 - DNA, 2991 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaaggtatggtatggccatgttagtgtgatacaagaaactgggtttagattttatatcaaggatatatggactctatctctgaatatactaaattgttaaattatattgcaaaataagttattctgttttccctccttaaaaattgcagttggatgtcagttctgattatgttggttactatgggaagctgatatttctaatgtaggttttggcagataagtactagaagccacaagaaggtggtatctgtgtctacatcaatggcttgactgtttggcatatttatctgtattctcttgttttttattttcttttgagatggcatctcagtcgcccaggctgcagtgcagtggcgcagtctcggctcactgcaacctctacctctcaggttcaagcgattctcctgcctcagcctcctaagtagctgggactacaggcatatgccaccacacccagcta

SEQ ID NO: 358685 - DNA, 3306 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagaggtattaaattatttatcagtcttgtttttgttggaattaacagaaacatttaacatttaataaaagatccattaaggtaaacatagtaattcatagcttagtagcacaatgatgccagagattttaaaccttgttttatactgtaattttggtagaaataagtagactacgaattcattctattttaaataaatttattcaatgggacatcattttaaatataagaacttgtgaaagaccatatttcctgttagtctcatggagcatgcttataatgctacgtactttaaacaatcttttaaaatgtcattttagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaaggtatggtatggccatgttagtgtgatacaagaaactgggtttagattttatatcaaggatatatggactctatctctgaatatactaaattgttaaattatattgcaaaataagttattctgttttccctccttaaaaattgcagttggatgtcagttctgattatgttggttactatgggaagctgatatttctaatgtaggttttggcagataagtactagaagccacaagaaggtggtatctgtgtctacatcaatggcttgactgtttggcatatttatctgtattctcttgttttttattttcttttgagatggcatctcagtcgcccaggctgcagtgcagtggcgcagtctcggctcactgcaacctctacctctcaggttcaagcgattctcctgcctcagcctcctaagtagctgggactacaggcatatgccaccacacccagcta

SEQ ID NO: 358686 - DNA, 2071 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatgtgagtttgtgttaattattaaaatgaaaaaaaaaatctatattgtaaatttactaattggaaaactttggccaaaaaaattgttttttaaggttttggactgacttaacttttaaatttggcttagggaactgatttctaaatattttcttaaggatctagtgataaagtcttgtttttaaataaaaggtagctgataactaaatataactctttttatcaccacactgaagactttgaataaacactacatttataacattatgaatgtcacaatttggcacattttaaattattcatagtatttcttggttattcatagtatttcttgttttatagccacatcttttatccccccaaaataacggttcttcacaattttaataagattcagcaaggtctttttttttcataatcttcagactgattttatgtatatgtaagttttcttttgaagatctgaaccattaatcccaattctctcttactcacattttaatagactattcatctcctaatatcttttcagtacaacattttttcttatctttcagcatttagggatggaacttgaggcttgcctcaagtgtttgctttttctgttttctaaccattagaatataaaaacattcaactgactactccatttgcagtcaccttgtttaatgcttcacccttctgtaagtggaatatgtaagatatattctgagttcatttttattgtttcttgtagctacaaaatagattccattagtgagactgtaccctgctgtttgtattagtttgaagtctcctctctacctatatcaggagtttcaaattcttttttgt

SEQ ID NO: 358687 - DNA, 940 bp, Homo sapiens
gtcggtaccgataaactattacagcataaactattcagcttcctacactattaagtttaccacagcataaactattcaagcagagtgctgtttttctttgcaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaacctaatacacgagaccaacaacactaggcaagcaccttggatggaggcagaaatactgaaaggccacggaaacacgagggcggtcagacatgctgtgaaagactccatagaaaagataatggcaaagccagggcaaggggagaaaagccatcaacgatagaaagaacagcagacggag

SEQ ID NO: 358688 - DNA, 2309 bp, Homo sapiens
catttataaacaattttcactccaatatgtagaataactttcatgatgggctttattagagggtagtgaattctttgtagattgaaaaaccatttggacattgtctagtctgtgaagatgtttcgggcattcagttagtggttagatttaaggaatttctccttctaaaattctaattacagttccccaaacacattgtctctgattcactgatgtattaccattgcctagaatagtgtctggcattagtaggcattcagaaaatgtttgttgagtaaatgaatgtttctatgtttatagttttccctcttccttgacattcttgccctgatagattgccttgtaaaatttgattcatctttatgagctcagttcatatgtcatccctgtttcacagaggatttatgcctttctggagtctcttaggcaaaattgtttccttctgtatttccatagcaccttgctaattctgcattctgttacactgtctaaaattaataattgtgtaaaactcttctacaagagattaactccttttgggcagtgacacaatgataatgctattcatttttatagtttttttttttaagcctactcccttggatatagtaacattcagtgagtgtttgattttagtttgattaggtatttaatgagtgaggaccaaattgtgagaagtaaatccacatgtagttagaccatttttctccataatagtggaatgagtaacactattgtatcttaaatcagaggaatatagaataaaataaagttcaaaacatagtaaaagggggatgtcttttatattgaaagtagaagttgatgttcactttttacgggctcagaatgtcttactgaagaggtagcatttgagatagttccttcccagattggttaggtatttatctaacaagtagaaagcaaaaagtggaaagtacattctaagaacaaaaagtacaagctacagtggtgggagattggcaaataggaagttatgtgtgaccatggtataggaaccaaaaaacaattggtagtatgagacaggaaatgtagacttgagtcctgtggtaaacgacttcagttgcagaatgagaaatttgtaggcagtagagaggtgttttttttttgtttggtttttcttaatgtagggcacagctgctgttgaaactgatgtatccagattagagtggtggagtaggacataattatattagttgggctgttgtttaagaaaagtcgataagagggcctgagttagggtaatggcaacaagaaaagattaagagaggtttggaaagatatttactgaacagaaacatctttttttatataaacataaataaggatagtgtggggatatgtttgcagatacgattttcatgaattttaataaaaattgattaatagttaattatataaaatactgtcttaatgtcttccctttagggccgggaagaagatccacatgaaggaaaaatgtgagtttgtgttaattattaaaatgaaaaaaaaaatctatattgtaaatttactaattggaaaactttggccaaaaaaattgttttttaaggttttggactgacttaacttttaaatttggcttagggaactgatttctaaatattttcttaaggatctagtgataaagtcttgtttttaaataaaaggtagctgataactaaatataactctttttatcaccacactgaagactttgaataaacactacatttataacattatgaatgtcacaatttggcacattttaaattattcatagtatttcttggttattcatagtatttcttgttttatagccacatcttttatccccccaaaataacggttcttcacaattttaataagattcagcaaggtctttttttttcataatcttcagactgattttatgtatatgtaagttttcttttgaagatctgaaccattaatcccaattctctcttactcacattttaatagactattcatctcctaatatcttttcagtacaacattttttcttatctttcagcatttagggatggaacttgaggcttgcctcaagtgtttgctttttctgttttctaaccattagaatataaaaacattcaactgactactccatttgcagtcaccttgtttaatgcttcacccttctgtaagtggaatatgtaagatatattctgagttcatttttattgtttcttgtagctacaaaatagattccattagtgagactgtaccctgctgtttgtattagtttgaagtctcctctctacctatatcaggagtttcaaattcttttttgt

SEQ ID NO: 358689 - DNA, 523 bp, Homo sapiens
gtaacattataaattaatagtggagtaattccacgtcatttataaacaattttcactccaatatgtagaataactttcatgatgggctttattagagggtagtgaattctttgtagattgaaaaaccatttggacattgtctagtctgtgaagatgtttcgggcattcagttagtggttagatttaaggaatttctccttctaaaattctaattacagttccccaaacacatttatactttcatgtattaactctagaatgtatgctctctgaggggagggatttttgtctctgattcactgatgtattaccattgcctagaatagtgtctggcattagtaggcattcagaaaatgtttgttgagtaaatgaatgtttctatgtttatagttttccctcttccttgacattcttgccctgatagattgccttgtaaaatttgattcatctttatgagctcagttcatatgtcatccctgtttcacagaggatttatgcctttctggagtctcttaggcaaaat

SEQ ID NO: 358690 - DNA, 470 bp, Homo sapiens
agatgcaggatcttgctgtgttgtccaggctggtatcaaactcctgggctcaagtgatcctcctggatagctgggattatatgcatgtaccactgtgcctagcacagtcattactgtttaatgattaattgaaaacattgattaagcacagagtattcttaagcaaactggtcttcactttttagaatcttcttattacgaagatttacatacagaatttagcagttttagccagtattccctaactatgcttaggttccttccaaattaggacaggtgtagatattactgaccagaagttactgctgcaaaatttctgctctctatttttatgtattaaagctggtaagatacaccagagagatagcagacaagcaatgtggatggttgtgaatcataaaccagaaaatttgaaagaaattatcttaaaaaaaaaacaagttcctggtgaaaatttacatatgtttatg

SEQ ID NO: 358691 - DNA, 4372 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358692 - DNA, 4437 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtaagttaagactgctgttcaggaatttgggaagctggctccagaaaagaagtggaaatgaaggggtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358693 - DNA, 764 bp, Homo sapiens
  misc_feature (753)..(753): n is a, c, g, or t
  misc_feature (762)..(762): n is a, c, g, or t
gatctggtacaatggagtattatttctttaagaattataattttatgttaattatttattgtgagtgttttggaagctggtataaatattttgctactttttattaagcttcctaataatttttgtttttattttaaaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagctatcgcaaaggactcagtagccaagcttacacatgtagnggggggggnga

SEQ ID NO: 358694 - DNA, 4516 bp, Homo sapiens
  misc_feature (4440)..(4440): n is a, c, g, or t
  misc_feature (4442)..(4442): n is a, c, g, or t
  misc_feature (4444)..(4444): n is a, c, g, or t
  misc_feature (4449)..(4449): n is a, c, g, or t
  misc_feature (4456)..(4456): n is a, c, g, or t
  misc_feature (4463)..(4463): n is a, c, g, or t
  misc_feature (4466)..(4466): n is a, c, g, or t
  misc_feature (4468)..(4468): n is a, c, g, or t
  misc_feature (4471)..(4471): n is a, c, g, or t
  misc_feature (4474)..(4475): n is a, c, g, or t
  misc_feature (4478)..(4479): n is a, c, g, or t
  misc_feature (4488)..(4488): n is a, c, g, or t
  misc_feature (4494)..(4494): n is a, c, g, or t
  misc_feature (4497)..(4497): n is a, c, g, or t
  misc_feature (4501)..(4501): n is a, c, g, or t
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtaagttaagactgctgttcaggaatttgggaagctggctccagaaaagaagtggaaatgaaggggtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataatccnancnccacncacaccnccccccnccncnccnccnnccnnccccccccncccccncanccanccccccttaaacccc

SEQ ID NO: 358695 - DNA, 3393 bp, Homo sapiens
gccggccccatggtcgagagaaataggacaggtgtagatattactgaccagaagttactgctgcaaaatttctgctctctatttttatgtattaaagctggtaagatacaccagagagatagcagacaagcaatgtggatggttgtgaatcataaaccagaaaatttgaaagaaattatcttaaaaaaaaaacaagttcctggtgaaaatttacatatgtttatgactttgaatgcactttgtaataatactacttaacatcttttcttttttatttgataattagggaaaaactaacagcttaattcttacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358696 - DNA, 3158 bp, Homo sapiens
tgaggaactccttatggcacatggcacattcataatattgatattttacagatttacctcaatttgacataacgacattttggggaattgtgggtgggggtgtgctttataaagtggaagaattttttccttaagactgttaaagaattattccaaaacaagaattctgacaatttcatcatgatgaaatctctgaagatatagttaaggtattctcagcatttactctgtgattaaaacaagtaatataacaaaaggcatttttgtacagatttgttataggcattttctcattatgtaagaattggcatattacataagctttggaataaaaattgattgattcatatttttagaaacactaattttaataatatgtaggatttcacaattgtttggctaagagaaaacaatttttttttttaaacaggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358697 - DNA, 2710 bp, Homo sapiens
gatctggtacaatggagtattatttctttaagaattataattttatgttaattatttattgtgagtgttttggaagctggtataaatattttgctactttttattaagcttcctaataatttttgtttttattttaaaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358698 - DNA, 2586 bp, Homo sapiens
gtcggtaccgataaactattacagcataaactattcagcttcctacactattaagtttaccacagcataaactattcaagcagagtgctgtttttctttgcaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358699 - DNA, 4304 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358700 - DNA, 2314 bp, Homo sapiens
tattgaatttgtgatgttactgaaaactcctttaatgaaaagcatttaacaccatagggaagactgaacaccaggaaaatttacttgcatgactaattatcgtgttctctttttaaacaataattgcttgtttttcttcccaagtatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358701 - DNA, 3240 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358702 - DNA, 1474 bp, Homo sapiens
agttgagacagtctgtgctgtaatcccgaagttaatcgagcaccgtacgatggaattggtgtcaactccaatgctagtcaaaatgcatctcaacaatcagttatgatcatgttgggagatgacctgggtaatgtactctgacctgttcggcaccctacataggatacgacaagggacctggtcccgctcgagtagtatcagcagttgcgatgagcattccgtgtgcgctcatgtcagatgcacactatcgaacatcagctacagtaaattgcagcgtgtgttagccaagcatggtgtttggcaccagctacttggctaataacatgaaagatgcttcaggctgagaggacaaatagcagtgataccccaagagacgcgacatggaaatggttgacgagtgaggacaacgccgcatgtactgtgccgccagatcgttgtcatcgcactagtgcacttcagtcgaatgtcacaatagcataggtcaagttctacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataat

SEQ ID NO: 358703 - DNA, 3431 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgtaagtggtgaaattttcatttgacaagaaattgtgtatctatgtcttcagaaatttctatttctaaaacgtgaaagcttttctgttgtcctaatattattatactctgaaaaagtcatggttaatctttatgagatgaattgtatttaaagaaaatagctgtcttaataaaaccacccattattttcgtacaagccaatatgtctggtttgtactgtagtagcttggggagtgaatagaggtttatagtttcagatttgagattgtaaaagatatcttgtctatccatttagtctatacttgatagactaatcactctgttaatatgcttgtcggcctccagtattagtgaactcacttgttcaggtagaagttaacttaagtctaaatcttgctccccagaatttgcagctggttggttctctatatctgaaagtaaatgtcaggaagttgactgaataaattgatgataaacttagtggataaagttttccttaccccttgctaaatgcctcattacctgtggcaaaatacttttttgggtaaaaggccagttttattgaactgtggtatatttgggtaaattaagcttttggctgctaggagatcagtgttttcacttgctttctgtgttgag

SEQ ID NO: 358704 - DNA, 1550 bp, Homo sapiens
aggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataaggtattttataatctattctcatgtataggcatttgaaagagctagacttcgaagatttattactcttggactaggaagcttttgaaatttgaagaaatggcatacagcaaggtgaaagagcttttgatattgggtctgttggtcctgtatctctgggttggcttatttgttcagactgtggttttggatcagggtggcctcagtgaatatgataggagaaatagttaggttttattccactgtctctcacaaagtaaggagagttctgcttcaatctatatgctatgtaaatttttgttaccatgtgacatttatgccacagctataaaggataagcttctactttatgtaatgggtgaataattttaaaccttaggaatgttatagaactatgcaacatgttagtttgtggttttatttctatataattatataatttgataatcagattatctgtgtc

SEQ ID NO: 358705 - DNA, 1142 bp, Homo sapiens
ggatggttggcttctggcattaggtgatcccctgggtccttgcaactccagcctgattgctctgccctcaatttcccttttattacaggaatttaaagcttctttagcgtcttcgaatgaagcaaactctataaatgcataccctttagatttgccattttggttctggggtactttcttggtgtaacgaactaatagcgcattctggaatttgtactctccaagctgctcaaaaagctcacaattttgtttgattaaattctgaggctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358706 - DNA, 1191 bp, Homo sapiens
  misc_feature (966)..(966): n is a, c, g, or t
ggctaggtagggctggtgtgtaatcggcaccgaggcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttcttggccaataacggtgcagttttccgttaacacaacaacgaaaaacccctacggggctcatatattcgngggcggcaaagaaagcgctccatgaaagttgcacatcggtcgtacatatgtgtccgggcacccgttcttgttccaaggggagaatatacagcgccccatagagagcgcataatttggaacggtcgcggatataaggagttgaaacagcaccatcgttagtagtagccattgtgcacatggcgcgtatcactcatagagatctacctgagccgacagcaatataca

SEQ ID NO: 358707 - DNA, 432 bp, Homo sapiens
ttatgcccggcgtgcaagaggaccccatcgcgaatcaccatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358708 - DNA, 976 bp, Homo sapiens
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcagctttgtccagtggctgtagcggtcccgttgctgcggtgagctggctgcgttgatgggcggtaagtggcctagctggtgctccattcttgagtgtgtggctttcgtacagtcatccctgtacaacctgttgtccagttgcacttcgctgcagagtaccgaagcgggatctgcgggaagcaaactgcaattcttcggcagcatcttcgccttccgacgaggtcgatacttataattcgggtatttctctctgtgcatggcctgtaatttctgtgcctcctggaagaatggccatttttcggcttcagtaagcattttccactggtatcccagctgcttgctgatctctgagtttcgcattctgggattctctagagccatcttgcgcctctgatcgcgagaccacacgatgaatgcgttcatgggtcgcttcactctatcctggacgttgcctttactgttttctcccgtttcacactgatacttagagttacagctttcagtgcaaaggaaggaagagcttctccggagagcgggaatattctcttgcacagctggactgtaatcatcgctgttgaatacgcttaacatagcagaagcatatgattgcattgtcaaaaacaaggagagtgcgacaaaattg

SEQ ID NO: 358709 - DNA, 364 bp, Homo sapiens
ccctgtcttgcgttcctgtgttttctaatgcacgcccgaggtcaaagagactttgatttggcagatgcccttgatgaccctgaacccaccaagaagccaaactcaggtgagtgtctcttcagctaggaaaaactgaggcaacgtccttgaactgatgcttacggaggggatggttgaggatgttttacagaactgtggggtatatgaaagagatgcaacaactgtaccagatagcagatattgaaagcaaaatgtggtgattagggaaatgcaaatcacaaccacagtgaagcaccacttcgtccccactgagatggctaaaatctaaaatggaaaataacaagtgttggcaaggatgtgatga

SEQ ID NO: 358710 - DNA, 389 bp, Homo sapiens
tatgtgcagctcagcagtgaggagtgggagggactgtgagaggcagataacctctcaggagacatgtataaggaagtgtttattttgttttagattttgttgggtggtggtctgttagctggctattaatgtgaaggaaggtatgaggcatgtgtgttttggtgggatgttgtttttctctcctccctttctttctgtacttacttttatctcctcttctattgcagggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358711 - DNA, 320 bp, Homo sapiens
ccctgtcttgcgttcctgtgttttctaatgcacgcccgaggtcaaagagactttgatttggcagatgcccttgatgaccctgaacccaccaagaagccaaactcagctttgtccagtggctgtagcggtcccgttgctgcggtgagctggctgcgttgatgggcgagttacagctttcagtgcaaaggaaggaagagcttctccggagagcgggaatattctcttgcacagctggactgtaatcatcgctgttgaatacgcttaacatagcagaagcatatgattgcattgtcaaaaacaaggagagtgcgacaaaattg

SEQ ID NO: 358712 - DNA, 255 bp, Homo sapiens
  misc_feature (18)..(18): n is a, c, g, or t
cgcggccgcgcgactggntgcgagaagacgtacgagggtgtgaaggatgccaatggcaacagcgccacgaggctccaacatgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358713 - DNA, 1939 bp, Homo sapiens
  misc_feature (723)..(723): n is a, c, g, or t
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcaggttcaaggggtacgtgggcaagctggttacatagaagtttacgaagcccctcatatcgtgatggaatgcagccctccggaagaatgccctgaaaatgataagcaggacagatcatgggtttccatgcctgttgcatgaatcactgcatttttagaaaaggttttacgacatggacagagctgtgcagccatcatcacgagctaatccaaagcaaggtattcgacttaaaattcaaatgccatgaaacctatccttcaatgtttacgtacagacgattttagtacttcccaaacctatgaaattggccccaatcctgaacaaggaatgatttgtctctgaaacaaatcatgattttgcaatcacagcatgtcacagtcacaaggaacntataggttatttctcacgattggcatttttttttaaggctcctaaatcgtgctgtttcaggacttttgctaaatattttgaaggtcggcgaaagataagtttaagagtgtaaactgcgtcctcccagctcagccaacttgacggggggtaggcacaacaaaaagtctgcggcataactgacacctgtaaatcagtatcagaaactgaaaatgctaagaaattcagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358714 - DNA, 1097 bp, Homo sapiens
ccctgtcttgcgttcctgtgttttctaatgcacgcccgaggtcaaagagactttgatttggcagatgcccttgatgaccctgaacccaccaagaagccaaactcagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358715 - DNA, 2171 bp, Homo sapiens
  misc_feature (723)..(723): n is a, c, g, or t
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcaggttcaaggggtacgtgggcaagctggttacatagaagtttacgaagcccctcatatcgtgatggaatgcagccctccggaagaatgccctgaaaatgataagcaggacagatcatgggtttccatgcctgttgcatgaatcactgcatttttagaaaaggttttacgacatggacagagctgtgcagccatcatcacgagctaatccaaagcaaggtattcgacttaaaattcaaatgccatgaaacctatccttcaatgtttacgtacagacgattttagtacttcccaaacctatgaaattggccccaatcctgaacaaggaatgatttgtctctgaaacaaatcatgattttgcaatcacagcatgtcacagtcacaaggaacntataggttatttctcacgattggcatttttttttaaggctcctaaatcgtgctgtttcaggacttttgctaaatattttgaaggtcggcgaaagataagtttaagagtgtaaactgcgtcctcccagctcagccaacttgacggggggtaggcacaacaaaaagtctgcggcataactgacacctgtaaatcagtatcagaaactgaaaatgctaagaaattcagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttcttaaaaaaacagaaaaaaaaaaaaaaaatttttgcgccgctggcgcaaaaaaattttctaaaaccattcttttggggcccggcaccagtgttagtgaacatggccaaactgtcccagaaatctgggctgcctaggtgtgggtttccccattaaaaagccgggaccgaggtttggaccacccagggctcggggctaccggttcaacagggccaaggtctaccccccgcggggggt

SEQ ID NO: 358716 - DNA, 2303 bp, Homo sapiens
  misc_feature (723)..(723): n is a, c, g, or t
  misc_feature (2303)..(2303): n is a, c, g, or t
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcaggttcaaggggtacgtgggcaagctggttacatagaagtttacgaagcccctcatatcgtgatggaatgcagccctccggaagaatgccctgaaaatgataagcaggacagatcatgggtttccatgcctgttgcatgaatcactgcatttttagaaaaggttttacgacatggacagagctgtgcagccatcatcacgagctaatccaaagcaaggtattcgacttaaaattcaaatgccatgaaacctatccttcaatgtttacgtacagacgattttagtacttcccaaacctatgaaattggccccaatcctgaacaaggaatgatttgtctctgaaacaaatcatgattttgcaatcacagcatgtcacagtcacaaggaacntataggttatttctcacgattggcatttttttttaaggctcctaaatcgtgctgtttcaggacttttgctaaatattttgaaggtcggcgaaagataagtttaagagtgtaaactgcgtcctcccagctcagccaacttgacggggggtaggcacaacaaaaagtctgcggcataactgacacctgtaaatcagtatcagaaactgaaaatgctaagaaattcagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttcttaaaagaaaaaccaaacaaacaacaacaacacaccagcaacccaccatcaacagaaaaagggggggggcgccaaagaaaaacaacccagggggcagccaacagatgagagcgtacacaggcgtgtgagaacaagagcgggccaccaaaagagggcgctactaacagaacaggccgcggcggcgaaacacaccacgaagcgagcggcacaacagcgcgccgcagccacctgcggaagacacccgccatgagcggggggccacagacggcacacacccccagagaagaagctcagcggaaatacaaacaccgcgaagtgcacacaccacaacatcgtcggaaaggtacggaatgctaatatagagcn

SEQ ID NO: 358717 - DNA, 2231 bp, Homo sapiens
  misc_feature (723)..(723): n is a, c, g, or t
  misc_feature (2006)..(2006): n is a, c, g, or t
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcaggttcaaggggtacgtgggcaagctggttacatagaagtttacgaagcccctcatatcgtgatggaatgcagccctccggaagaatgccctgaaaatgataagcaggacagatcatgggtttccatgcctgttgcatgaatcactgcatttttagaaaaggttttacgacatggacagagctgtgcagccatcatcacgagctaatccaaagcaaggtattcgacttaaaattcaaatgccatgaaacctatccttcaatgtttacgtacagacgattttagtacttcccaaacctatgaaattggccccaatcctgaacaaggaatgatttgtctctgaaacaaatcatgattttgcaatcacagcatgtcacagtcacaaggaacntataggttatttctcacgattggcatttttttttaaggctcctaaatcgtgctgtttcaggacttttgctaaatattttgaaggtcggcgaaagataagtttaagagtgtaaactgcgtcctcccagctcagccaacttgacggggggtaggcacaacaaaaagtctgcggcataactgacacctgtaaatcagtatcagaaactgaaaatgctaagaaattcagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttcttggccaataacggtgcagttttccgttaacacaacaacgaaaaacccctacggggctcatatattcgngggcggcaaagaaagcgctccatgaaagttgcacatcggtcgtacatatgtgtccgggcacccgttcttgttccaaggggagaatatacagcgccccatagagagcgcataatttggaacggtcgcggatataaggagttgaaacagcaccatcgttagtagtagccattgtgcacatggcgcgtatcactcatagagatctacctgagccgacagcaatataca

SEQ ID NO: 358718 - DNA, 903 bp, Homo sapiens
gcactgtggacgctctcttgacggatgctagggagacccgccaagttttcaaaggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358719 - DNA, 1959 bp, Homo sapiens
  misc_feature (723)..(723): n is a, c, g, or t
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcaggttcaaggggtacgtgggcaagctggttacatagaagtttacgaagcccctcatatcgtgatggaatgcagccctccggaagaatgccctgaaaatgataagcaggacagatcatgggtttccatgcctgttgcatgaatcactgcatttttagaaaaggttttacgacatggacagagctgtgcagccatcatcacgagctaatccaaagcaaggtattcgacttaaaattcaaatgccatgaaacctatccttcaatgtttacgtacagacgattttagtacttcccaaacctatgaaattggccccaatcctgaacaaggaatgatttgtctctgaaacaaatcatgattttgcaatcacagcatgtcacagtcacaaggaacntataggttatttctcacgattggcatttttttttaaggctcctaaatcgtgctgtttcaggacttttgctaaatattttgaaggtcggcgaaagataagtttaagagtgtaaactgcgtcctcccagctcagccaacttgacggggggtaggcacaacaaaaagtctgcggcataactgacacctgtaaatcagtatcagaaactgaaaatgctaagaaattcagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctccggtgatgtgttgcactaccctcctcattacgcacaaataacaatgacctccgctgtgtggtttaaccccggccccatata

SEQ ID NO: 358720 - DNA, 1884 bp, Homo sapiens
  misc_feature (723)..(723): n is a, c, g, or t
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcaggttcaaggggtacgtgggcaagctggttacatagaagtttacgaagcccctcatatcgtgatggaatgcagccctccggaagaatgccctgaaaatgataagcaggacagatcatgggtttccatgcctgttgcatgaatcactgcatttttagaaaaggttttacgacatggacagagctgtgcagccatcatcacgagctaatccaaagcaaggtattcgacttaaaattcaaatgccatgaaacctatccttcaatgtttacgtacagacgattttagtacttcccaaacctatgaaattggccccaatcctgaacaaggaatgatttgtctctgaaacaaatcatgattttgcaatcacagcatgtcacagtcacaaggaacntataggttatttctcacgattggcatttttttttaaggctcctaaatcgtgctgtttcaggacttttgctaaatattttgaaggtcggcgaaagataagtttaagagtgtaaactgcgtcctcccagctcagccaacttgacggggggtaggcacaacaaaaagtctgcggcataactgacacctgtaaatcagtatcagaaactgaaaatgctaagaaattcagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358721 - DNA, 696 bp, Homo sapiens
ccctgtcttgcgttcctgtgttttctaatgcacgcccgaggtcaaagagactttgatttggcagatgcccttgatgaccctgaacccaccaagaagccaaactcagatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358722 - DNA, 1085 bp, Homo sapiens
cccgagtaggtgggattacaggcatgtgccaccacccgggctaattttgtatttttggtagagacggggtttctccatgttggtcaggctggtcttgaactcccgacctcaggtgatctgcctgctttggcctcccaaagtattgagattacaggcatgagccaccgcacccggcaaaagccacatgttcttagcagttcttagtagtggtagagttaagtttgtctctggggctctttgttaccaccgctccagagttgcccattgaggactatcaattggaaatatgtccctgaggaattttagcctgtgataaaggaccagaggttagttcagctgagcactcttccagcagccaccagagggttctgaaacagattcccccttggcaaggtttcccaaatgtctaaattactaaatcagtatgggagatcatcagctctgtgactggttaatatagtttttcccaagagcactccttctctgaccgaggaaatgctggaaatcgatgggataagtaatgtctgggtgactgctttaggctggctttgtgtttacatattgaattgattttccttgctgtgtttatagtatacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358723 - DNA, 1139 bp, Homo sapiens
cccgagtaggtgggattacaggcatgtgccaccacccgggctaattttgtatttttggtagagacggggtttctccatgttggtcaggctggtcttgaactcccgacctcaggtgatctgcctgctttggcctcccaaagtattgagattacaggcatgagccaccgcacccggcaaaagccacatgttcttagcagttcttagtagtggtagagttaagtttgtctctggggctctttgttaccaccgctccagagttgcccattgaggactatcaattggaaatatgtccctgaggaaaaaatgatataccagttgattgtgtgttaccactcagatacacaggcaacaggcttttagcctgtgataaaggaccagaggttagttcagctgagcactcttccagcagccaccagagggttctgaaacagattcccccttggcaaggtttcccaaatgtctaaattactaaatcagtatgggagatcatcagctctgtgactggttaatatagtttttcccaagagcactccttctctgaccgaggaaatgctggaaatcgatgggataagtaatgtctgggtgactgctttaggctggctttgtgtttacatattgaattgattttccttgctgtgtttatagtatacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358724 - DNA, 513 bp, Homo sapiens
tgattcacgaggaccgaaccgtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358725 - DNA, 2031 bp, Homo sapiens
  misc_feature (723)..(723): n is a, c, g, or t
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcaggttcaaggggtacgtgggcaagctggttacatagaagtttacgaagcccctcatatcgtgatggaatgcagccctccggaagaatgccctgaaaatgataagcaggacagatcatgggtttccatgcctgttgcatgaatcactgcatttttagaaaaggttttacgacatggacagagctgtgcagccatcatcacgagctaatccaaagcaaggtattcgacttaaaattcaaatgccatgaaacctatccttcaatgtttacgtacagacgattttagtacttcccaaacctatgaaattggccccaatcctgaacaaggaatgatttgtctctgaaacaaatcatgattttgcaatcacagcatgtcacagtcacaaggaacntataggttatttctcacgattggcatttttttttaaggctcctaaatcgtgctgtttcaggacttttgctaaatattttgaaggtcggcgaaagataagtttaagagtgtaaactgcgtcctcccagctcagccaacttgacggggggtaggcacaacaaaaagtctgcggcataactgacacctgtaaatcagtatcagaaactgaaaatgctaagaaattcagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggctgtaaaaacaaaaacaagccaaacaagccagcaagcaaacaagaagaagaaaacaacaacaacacaaaccttgaaatagacttgtcagatgtaaatatttcttttctagggaaatagaaggtgtacagtggagttttctggaggctacatgacatgtgataagaaaacagactgaaaaagggaatacatctataaagagaaaattgctatcactgtttttggttgggaaaaacatttgtatgagataaacatgttattcttttcataatcagacattcttctcacaagtgttggttctctaccattcctcaaaggtgataattttttgaaatatgttattgtggattcatgattttggatatatccaatgggtttaagtgcattgcaataaaatggtattttgatactca

SEQ ID NO: 358726 - DNA, 117 bp, Homo sapiens
tatacccttttgtgatcagatgtcatcagcatcgagaagacaggtgaacatttccgcctggtctatgacaccaagggccgttttgctgttcaccgcatcacagtggaagaggcaaag

SEQ ID NO: 358727 - DNA, 1509 bp, Homo sapiens
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcaggtcttgttgccttcgttccccggtactactgaatcgtccagtttaagagggataaagtggcgtcgcacaggagcgaggatggagagcggcgactaggcggctatggagaggtacagcgtccagttgcgcccagccacactgcaggacgccgcccccgccacactacacctgataccctgcggcccaccacggtgtggcgcttcatcacgcctgccatccgccagggccccgagggactcttaagtgtagtttcggggccgcagtctacggggcgacgaggtggcagtgccgtccggcctcgtgggatacgtgatggtgactgaacaggaggaggtgtcgatggggaagccagacccctggcggggttccgggagtgacaaccaagaagaggaacctctggagcgggactttgaccgcttcctcggaaccactaccagcttcagccgcttcaccctgtagggcatggggcttcaccctgtggggcaccctgtggggcttccttggcccggaagccaaactgcgtggggccttaacttggcccagcctcgcggcaacgattcacgcgcaggtgcccaaggacacagaaccagagcttgaaattcaaagccgcgaaccctttacagcagtaaaccagctccttactttgtagccactggttccatcaccccagtaaaggagttcttcacagcacacattcacaaaagataaagtggtgaattttatattcttatatacatatgtccaaccatctatatgtttttaagaaggcaaaaaagacctcccagatgcatatattacaggacggggtgtgtgaggagactcacttgggggtggcagtcaacaaaatttaaataaagacacgagattttattatttttctgtctacagctcctaggatagtgtgtgacatgtagtaggttctcagtatacttctctggtacttaaattaatgaaatgtgtaaacatgcctctgggttcagaaaaacaaactcaaccacttaaaaaaaaaaaaaggaaaaaagtgttggttctcctgtaaagtaataaacctacatgcaaaaataaggatgcagggggaggccgagagcattaaatttgcctctataatatcatatcaacacattttaatctctcaaccagggctaataattcactcactgtctccaggggact

SEQ ID NO: 358728 - DNA, 366 bp, Homo sapiens
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcagatatctacccaaagccaaaaccaccttact

SEQ ID NO: 358729 - DNA, 1153 bp, Homo sapiens
ccctgtcttgcgttcctgtgttttctaatgcacgcccgaggtcaaagagactttgatttggcagatgcccttgatgaccctgaacccaccaagaagccaaactcaggttttacgacatggacagagctgtgcagccatcatcacgagctaatccaaagcaagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358730 - DNA, 1999 bp, Homo sapiens
  misc_feature (723)..(723): n is a, c, g, or t
  misc_feature (1951)..(1951): n is a, c, g, or t
  misc_feature (1956)..(1956): n is a, c, g, or t
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcaggttcaaggggtacgtgggcaagctggttacatagaagtttacgaagcccctcatatcgtgatggaatgcagccctccggaagaatgccctgaaaatgataagcaggacagatcatgggtttccatgcctgttgcatgaatcactgcatttttagaaaaggttttacgacatggacagagctgtgcagccatcatcacgagctaatccaaagcaaggtattcgacttaaaattcaaatgccatgaaacctatccttcaatgtttacgtacagacgattttagtacttcccaaacctatgaaattggccccaatcctgaacaaggaatgatttgtctctgaaacaaatcatgattttgcaatcacagcatgtcacagtcacaaggaacntataggttatttctcacgattggcatttttttttaaggctcctaaatcgtgctgtttcaggacttttgctaaatattttgaaggtcggcgaaagataagtttaagagtgtaaactgcgtcctcccagctcagccaacttgacggggggtaggcacaacaaaaagtctgcggcataactgacacctgtaaatcagtatcagaaactgaaaatgctaagaaattcagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttcttcaacaaaaaaanaacanaaaacaaagggggcgcaagtataccggggcacacacaccactt

SEQ ID NO: 358731 - DNA, 1963 bp, Homo sapiens
  misc_feature (723)..(723): n is a, c, g, or t
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcaggttcaaggggtacgtgggcaagctggttacatagaagtttacgaagcccctcatatcgtgatggaatgcagccctccggaagaatgccctgaaaatgataagcaggacagatcatgggtttccatgcctgttgcatgaatcactgcatttttagaaaaggttttacgacatggacagagctgtgcagccatcatcacgagctaatccaaagcaaggtattcgacttaaaattcaaatgccatgaaacctatccttcaatgtttacgtacagacgattttagtacttcccaaacctatgaaattggccccaatcctgaacaaggaatgatttgtctctgaaacaaatcatgattttgcaatcacagcatgtcacagtcacaaggaacntataggttatttctcacgattggcatttttttttaaggctcctaaatcgtgctgtttcaggacttttgctaaatattttgaaggtcggcgaaagataagtttaagagtgtaaactgcgtcctcccagctcagccaacttgacggggggtaggcacaacaaaaagtctgcggcataactgacacctgtaaatcagtatcagaaactgaaaatgctaagaaattcagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttcttaaaaaaaaaaatatcaacataacc

SEQ ID NO: 358732 - DNA, 2000 bp, Homo sapiens
  misc_feature (723)..(723): n is a, c, g, or t
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcaggttcaaggggtacgtgggcaagctggttacatagaagtttacgaagcccctcatatcgtgatggaatgcagccctccggaagaatgccctgaaaatgataagcaggacagatcatgggtttccatgcctgttgcatgaatcactgcatttttagaaaaggttttacgacatggacagagctgtgcagccatcatcacgagctaatccaaagcaaggtattcgacttaaaattcaaatgccatgaaacctatccttcaatgtttacgtacagacgattttagtacttcccaaacctatgaaattggccccaatcctgaacaaggaatgatttgtctctgaaacaaatcatgattttgcaatcacagcatgtcacagtcacaaggaacntataggttatttctcacgattggcatttttttttaaggctcctaaatcgtgctgtttcaggacttttgctaaatattttgaaggtcggcgaaagataagtttaagagtgtaaactgcgtcctcccagctcagccaacttgacggggggtaggcacaacaaaaagtctgcggcataactgacacctgtaaatcagtatcagaaactgaaaatgctaagaaattcagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttcttaaaaaaaaaaacaaacaaagggggggggctaaagtttccccggggggccaatttaggtaca

SEQ ID NO: 358733 - DNA, 2200 bp, Homo sapiens
  misc_feature (723)..(723): n is a, c, g, or t
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcaggttcaaggggtacgtgggcaagctggttacatagaagtttacgaagcccctcatatcgtgatggaatgcagccctccggaagaatgccctgaaaatgataagcaggacagatcatgggtttccatgcctgttgcatgaatcactgcatttttagaaaaggttttacgacatggacagagctgtgcagccatcatcacgagctaatccaaagcaaggtattcgacttaaaattcaaatgccatgaaacctatccttcaatgtttacgtacagacgattttagtacttcccaaacctatgaaattggccccaatcctgaacaaggaatgatttgtctctgaaacaaatcatgattttgcaatcacagcatgtcacagtcacaaggaacntataggttatttctcacgattggcatttttttttaaggctcctaaatcgtgctgtttcaggacttttgctaaatattttgaaggtcggcgaaagataagtttaagagtgtaaactgcgtcctcccagctcagccaacttgacggggggtaggcacaacaaaaagtctgcggcataactgacacctgtaaatcagtatcagaaactgaaaatgctaagaaattcagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctttcgtttcttaatgtgttttttcccccttgtggataatagtagggtttgaatttgctcatgattttggcactgtcttaagatctctaggaataccacctatacttcctctgaccctccagtaaataaacctttgcttccctcatacatgttacccacaccatctctgtgggcagagtgatggagtagcattccaaaacgaagtacaaaaaacgtatgacatttcagaaaggacggcattcttttgtggaagctatgggagat

SEQ ID NO: 358734 - DNA, 899 bp, Homo sapiens
ggctaggtagggctggtgtgtaatcggcaccgaggcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358735 - DNA, 797 bp, Homo sapiens
gtgtccttttcaggcccggggccccaagaagcacttaaagcgtgttgcagcgccgaagcattggatgcttgacaaactaacgggtgtatttgaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358736 - DNA, 1843 bp, Homo sapiens
  misc_feature (723)..(723): n is a, c, g, or t
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcaggttcaaggggtacgtgggcaagctggttacatagaagtttacgaagcccctcatatcgtgatggaatgcagccctccggaagaatgccctgaaaatgataagcaggacagatcatgggtttccatgcctgttgcatgaatcactgcatttttagaaaaggttttacgacatggacagagctgtgcagccatcatcacgagctaatccaaagcaaggtattcgacttaaaattcaaatgccatgaaacctatccttcaatgtttacgtacagacgattttagtacttcccaaacctatgaaattggccccaatcctgaacaaggaatgatttgtctctgaaacaaatcatgattttgcaatcacagcatgtcacagtcacaaggaacntataggttatttctcacgattggcatttttttttaaggctcctaaatcgtgctgtttcaggacttttgctaaatattttgaaggtcggcgaaagataagtttaagagtgtaaactgcgtcctcccagctcagccaacttgacggggggtaggcacaacaaaaagtctgcggcataactgacacctgtaaatcagtatcagaaactgaaaatgctaagaaattcagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaattgttaaggttcacagagtgcagcaagctctctatttagagcctctgagaagaaacaagattagatc

SEQ ID NO: 358737 - DNA, 1857 bp, Homo sapiens
  misc_feature (723)..(723): n is a, c, g, or t
cccacaggttttcagcggtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcaggttcaaggggtacgtgggcaagctggttacatagaagtttacgaagcccctcatatcgtgatggaatgcagccctccggaagaatgccctgaaaatgataagcaggacagatcatgggtttccatgcctgttgcatgaatcactgcatttttagaaaaggttttacgacatggacagagctgtgcagccatcatcacgagctaatccaaagcaaggtattcgacttaaaattcaaatgccatgaaacctatccttcaatgtttacgtacagacgattttagtacttcccaaacctatgaaattggccccaatcctgaacaaggaatgatttgtctctgaaacaaatcatgattttgcaatcacagcatgtcacagtcacaaggaacntataggttatttctcacgattggcatttttttttaaggctcctaaatcgtgctgtttcaggacttttgctaaatattttgaaggtcggcgaaagataagtttaagagtgtaaactgcgtcctcccagctcagccaacttgacggggggtaggcacaacaaaaagtctgcggcataactgacacctgtaaatcagtatcagaaactgaaaatgctaagaaattcagttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaacttagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358738 - DNA, 1060 bp, Homo sapiens
ggatggttggcttctggcattaggtgatcccctgggtccttgcaactccagcctgattgctctgccctcaatttcccttttattacaggaatttaaagcttctttagcgtcttcgaatgaagcaaactctataaatgcataccctttagatttgccattttggttctggggtactttcttggtgtaacgaactaatagcgcattctggaatttgtactctccaagctgctcaaaaagctcacaattttgtttgattaaattctgaggctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaacttagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttctt

SEQ ID NO: 358739 - DNA, 462 bp, Homo sapiens
aaatggctagaaatgctatttattgccctatgataagtgaaatagcaaatcactcttgattcttaaaatttcatattaaaattagctagttcctacatgcatgcgtgcacaagtatatgcagacacacacacaaatcagtaatctatgtgaactagatactaatactaaattactatttaaattgggtccagaaagatgctgttttgaaaagaacactaaaaatatttcattagcgttttcttgataacaaataggaaaatatatgtttacaccctgaataaattcagctgtgggtggatttttgtttttcaaaatgattttgttagtttgaatgaaacctaaatataacattcaagtcaattcttttaacatttttctttataacagaatatgaaaaacgctgtcttaaagtgttgtaacttttctgaattttcaataaaatattttgcttgcaaaaaaat

SEQ ID NO: 358740 - DNA, 409 bp, Homo sapiens
gcattactctcattacttaagtctcaaatgctacctccttagagatgccttcctggatcacctcctctaaaaaacaaaccaaagcaagcccaaacctggcccttaactccagtcactctctgtactatcacctggtttgtggccttcatagtgccttcccccaatctgatattatcttgtttgtctgtttcttaattattttctatctccctcccctactaaaatgaaagctcgttttagtaaagtcatctggttgcttaataaacaaatttctattcagcagcttctgtgagctgagccctggagatacaggagaactcaggacagagcccctgcccttaaggtgcttatggaatgtggagtgtcacagtgtccatcaggtgatcaaacaataaagcataacagcaaa

SEQ ID NO: 358741 - DNA, 375 bp, Homo sapiens
agagccagccagacatgaggagggcacggggtctcatgcctccacccactctgctgtccagcccttctccctcaactcgccccagccatttcatccattcattccttctcaaagatttgagaatctgttcaggagagggaaacaggcatgccctgatgaacagacactcacggacacatggatgcacaaacacccgggggatgcacgatcacacaaacccacgcagtgatgaatgtgcacatacagcagcttctgtgagctgagccctggagatacaggagaactcaggacagagcccctgcccttaaggtgcttatggaatgtggagtgtcacagtgtccatcaggtgatcaaacaataaagcataacagcaaa

SEQ ID NO: 358742 - DNA, 541 bp, Homo sapiens
cggggagggtccgaagtggggccagctccctggagtcaggcatgtctgtctcaagctgcccctgtcccttgctgaatgggaacccccaccagctgcctcgggagcccgtgtccttacactctattcggatctgctccagctccgtcacctcagcaatggactccttcaggtcctccacgaacttctgcatctcgtccgagcccagggcacagaaatgcagcacctgcttcttctccctcaactcgccccagccatttcatccattcattccttctcaaagatttgagaatctgttcaggagagggaaacaggcatgccctgatgaacagacactcacggacacatggatgcacaaacacccgggggatgcacgatcacacaaacccacgcagtgatgaatgtgcacatacagcagcttctgtgagctgagccctggagatacaggagaactcaggacagagcccctgcccttaaggtgcttatggaatgtggagtgtcacagtgtccatcaggtgatcaaacaataaagcataacagcaaa

SEQ ID NO: 358743 - DNA, 1992 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggttggtgtcaaaggaaatccccaaggcttcaaccagggtctggattgtgatgtgatcgtagctgaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagt

SEQ ID NO: 358744 - DNA, 412 bp, Homo sapiens
ctagctcggcacccgatatgtattttttatttcctaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagtaaataaaaaatacatatcgggtacgagctgcacga

SEQ ID NO: 358745 - DNA, 2355 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggttggtgtcaaaggaaatccccaaggcttcaaccagggtctggattgtgatgtgatcgtagctgaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagttgggattctgaagtccattctggctctgctacttaacagtgtataatcttgtgcaactcatctctcagtattatatgtgaaatgggagtattacctcattgggttgctgtgaaggttcaaactaaatgagtgcatgggaaacattaaaatgatcattataggctaggcacagtggctcacacctgtaatccgagcactttgggaagccgaggtaggagggtaactgtagcccaggagttcaagatctcctgcctcagcctccccgagtagctgggactataggcgcgtgccaccatgcccggctaattttttgtatttttagtagagtcggggtttcactatgttggccaggctggtctcaaa

SEQ ID NO: 358746 - DNA, 2590 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcaggtctcttggaagggaatgaggtgggatgggtttgtcagaagcagccattccttttcagcatattccttccagtcattggggttctgtctgtaatcttatttagtttatggtttgtgtaagtcctccagaccctgaaggtgtactttcagaagtgcattgtgtgggaagaatacaggctgtactcccaaataactgagattttttttttaaaagctccctccctcttagaatagcaaagtatgtctgtctctgagccacagtgaaagttaaagtactctgaaaggaggataatcttaggagaaaaggaacctaaactcttaggtcagtgttttattctgttctacccaagtctcctgcactgcttgccttccagtggtaaaacaggaaaccaagtctttactcagagaggaattacaattgttctgtagtatgaattatggatttccatgctacctgcctcccttaaaactcttgaaggaagctctaatgatagaattaggggagggtaataaaatagacattttgaaatcatttggaatttgaactgttggatctacatctggagcaccatcttgattctccctttttattttcccagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggttggtgtcaaaggaaatccccaaggcttcaaccagggtctggattgtgatgtgatcgtagctgaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagt

SEQ ID NO: 358747 - DNA, 2280 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggtgagcagcagtggggcccaattcaataggtggagcacaaagaagaatcatttgatttcttactgagaaaaagttcaaaggtgtggtttcataaggtaatctgttatctgtggtgagcaggttggtgtcaaaggaaatccccaaggcttcaaccagggtctggattgtgatgtgatcgtagctgaggtatgtgcttcccaggcctccaaagcttccacatttttgttggtatcagttattcatgttgggtgtattctcatcccagatttttctcatttagatcataaacataatagaaagggctagaattgcaatcttgtgtaacttaaaaagcagctagtttttatttcctaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagt

SEQ ID NO: 358748 - DNA, 3367 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggtgagcagcagtggggcccaattcaataggtggagcacaaagaagaatcatttgatttcttactgagaaaaagttcaaaggtgtggtttcataaggtaatctgttatctgtggtgagcaggttggtgtcaaaggaaatccccaaggcttcaaccagggtctggattgtgatgtgatcgtagctgaggtatgtgcttcccaggcctccaaagcttccacatttttgttggtatcagttattcatgttgggtgtattctcatcccagatttttctcatttagatcataaacataatagaaagggctagaattgcaatcttgtgtaacttaaaaagcagctagtttttatttcctaggttcgttccaccagtcataaaccagatgaaatctatggcatgattgaaagactatctcctggcactcgcaagattgagttatttggacgaccacacaatgtgcaacccaactggtaaggtgaccagagaacaggctagtcctcaaggggctattatttatgattaaggacagaacttagtagagcttcacattgttttacactagtccataaatgagcttcacaggattcataagccacttaagcttgtatttaaactgttttatgagattctacaaatattcattagaaactcaacaggttctaggacccaaaagcactgctccctagggtttctactctcttcacaacccaaggatcttcctcagccattctgtgatgtattgaatctgccccctggtggttacgaagttatctatttaatctgtcaataattacatctttcaccccttaacagagcttaaaacacatgctgctagcattttgcttatccaaagaatactccctggtagcaactctgtgaagcaggcctggctaagcattagttactaaccctcagataatacagatccagtctattttaacaccagaatctatgccaattctgaactagtaattctaccatatactattctaatgttaagctctttttagaattggcatatttgatatgatgataggcagtcttcatttggtatgcattttttaacaatattaaaccctctaattccaggatttctggtttgcccctccttttacactgtttcaggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagttgggattctgaagtccattctggctctgctacttaacagtgtataatcttgtgcaactcatctctcagtattatatgtgaaatgggagtattacctcattgggttgctgtgaaggttcaaactaaatgagtgcatgggaaacattaaaatgatcattataggctaggcacagtggctcacacctgtaatccgagcactttgggaagccgaggtaggagggtaactgtagcccaggagttcaagactagactgggcaacatagtgagaccccatctctactgctaccctccaaaaccattaaaaaaacaggaatgcaggctgggtgcggtggctcatgcctgtaatcccagcactttgggaggtcaaggcgggcggatcatgaggtcaggagttcgagaccagcctggccaacatggtgaaaccctgtctcta

SEQ ID NO: 358749 - DNA, 2443 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtaagtagtggttgtgttgctttcttttgagggtaatactgttacagtgagatacatgttctcttctcccagactattctgtgattccttgcttctataaatggtactacccctaaactgtaaaagtttggctaaaattctagttcttttttatgccccacaggtatgaacgggtagatgaaattatttgggtgaagacaaatcaactgcaacgcatcattcggacaggccgtacaggtcactggttgaaccatgggaaggaacactgcttggtgagcagcagtggggcccaattcaataggtggagcacaaagaagaatcatttgatttcttactgagaaaaagttcaaaggtgtggtttcataaggtaatctgttatctgtggtgagcaggttggtgtcaaaggaaatccccaaggcttcaaccagggtctggattgtgatgtgatcgtagctgaggtatgtgcttcccaggcctccaaagcttccacatttttgttggtatcagttattcatgttgggtgtattctcatcccagatttttctcatttagatcataaacataatagaaagggctagaattgcaatcttgtgtaacttaaaaagcagctagtttttatttcctaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagt

SEQ ID NO: 358750 - DNA, 2101 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggtgagcagcagtggggcccaattcaataggtggagcacaaagaagaatcatttgatttcttactgagaaaaagttcaaaggtgtggtttcataaggtaatctgttatctgtggtgagcaggttggtgtcaaaggaaatccccaaggcttcaaccagggtctggattgtgatgtgatcgtagctgaggtatgtgcttcccaggcctccaaagcttccacatttttgttggtatcagttattcatgttgggtgtattctcatcccagatttttctcatttagatcataaacataatagaaagggctagaattgcaatcttgtgtaacttaaaaagcagctagtttttatttcctaggttcgttccaccagtcataaaccagatgaaatctatggcatgattgaaagactatctcctggcactcgcaagattgagttatttggacgaccacacaatgtgcaacccaactggtaaggtgaccagagaacaggctagtcaagtgaagcagtgggagtggc

SEQ ID NO: 358751 - DNA, 1590 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcaggtaatgcaattcagttacgtaggtatggacagatacagtacaattgaggcctgagctgggaggatcacttgagcctgggagttcagtgggagaaacagtgagttatgattacacacctacactctggcctgggtacaacaggatccatctct

SEQ ID NO: 358752 - DNA, 2266 bp, Homo sapiens
ttcagcaaagtattaagatttttgtgtttgtgagtgttataggtaacactgttggcccccaacattgtcattttgtacactttgttgatcagtggcctgaattcattaaaattcacactacatgcctcaaaaagaatattggatcccagcctaggttgttgagtatattcctgtcctttattaaaatgtaggttgatagaaaggtggtagggatatttaaatctatcatgctaatttactttctttgtatcacagcaaggatagggaattaggaaaagattactcactcaatagagaaaaggtagatagaaaatccagtattatcttgacaaagcagtgaatgttttagtatgattgaggataggtaatctagtgctaaagttggtcacagaatttcctgcacaaaatgaaagatctgtgtatgggaatgctagagaatttgacttctcagaaatatatagaccaacagtggttgccttttttcattttcacttctcttcattcttagatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggttggtgtcaaaggaaatccccaaggcttcaaccagggtctggattgtgatgtgatcgtagctgaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagt

SEQ ID NO: 358753 - DNA, 2002 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtaggggtcatgtgaaaatactctcacaatatgctcttaattatagctttgtttgacagggatttacccctagggcaaggaactgtttacagcagtggttctcaactggggatgattccctactgcccaactcccaggggatctggtaatgtccggagacatttttattgtcacacatgggggagtgctattggcatctagtgggggtagaggccagggatgttgtcaaacatcctacagtgcatagtgggacaaacccccacaacaaacagttgtctgtcccaaagtgtcaacaatgccaatgtcgacaaattcttatttagataatctgtcactgaatctgaaagaattggatcaagagaagaggaatccaaatatatagaaatatagggagatgaatggagaggaatactagaccaattatggaaattgactaaataatgtgaattggttctgagtataagtattggcctgacatgagttcttatctgtttggtacttctagtgcgtgagtttgaacaagttaattaacttctcttgagccttagtcttctcatctgtaacatgaagataataccagcgtatcctgccttatagaattgaatagactctgagctaaaaagtaaagtgtttagcactatactttttagttcagcacccagtaaatatgttttttgtagaaggaatgccttcctggggaggggatgttaacataatgcttagcggtaggaaccaggcctcttccattttaatttcatcccaaatgcatatttgtgaggaaggactgaacccctaacaaatctcttatctgaaggctccaattttccaatattaagttagctaatttaggtctaggcacaatggctcattcctgtaatctcaacactttgggaggccaaggcgtgaggatcacctgaggcgaggagttcaagactggcctgggcaacatagaccctatccctatagaaagtaaagtaattaaaacattagctggcatggtgtcacgcacctatattcccagctacaattgaaggctgagctgggaggatcacttgagcctgggagttcagtgggagaaacagtgagttatgattacacaactacactctggcctgggtgacagcaagatcccatctcttaaaaaa

SEQ ID NO: 358754 - DNA, 1699 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgagcatcggaaccagcaaaggagccagccaagaaatcaaggaaacatgctgcctcagatgttgatctggagatagagagccttctgaaccaacagtccactaaggaacaacagagcaagaaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggttggtgtcaaaggaaatccccaaggcttcaaccagggtctggattgtgatgtgatcgtagctgaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagt

SEQ ID NO: 358755 - DNA, 1831 bp, Homo sapiens
tcttagaagacattaatgtcaaaaagaatttgcggagttggtctaagagccaatttgatctataagacattttaagtccaaggctacttctgtcacaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcaggtctcttggaagggaatgaggtgggatgggtttgtcagaagcagccattccttttcagcatattccttccagtcattggggttctgtctgtaatcttatttagtttatggtttgtgtaagtcctccagaccctgaaggtgtactttcagaagtgcattgtgtgggaagaatacaggctgtactcccaaataactgagattttttttttaaaagctccctccctcttagaatagcaaagtatgtctgtctctgagccacagtgaaagttaaagtactctgaaaggaggataatcttaggagaaaaggaacctaaactcttaggtcagtgttttattctgttctacccaagtctcctgcactgcttgccttccagtggtaaaacaggaaaccaagtctttactcagagaggaattacaattgttctgtagtatgaattatggatttccatgctacctgcctcccttaaaactcttgaaggaagctctaatgatagaattaggggagggtaataaaatagacattttgaaatcatttggaatttgaactgttggatctacatctggagcaccatcttgattctccctttttattttcccagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggttggtgtcaaaggaaatccccaaggcttcaaccagggtctggattgtgatgtgatcgtagctgaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagt

SEQ ID NO: 358756 - DNA, 1270 bp, Homo sapiens
tctactgagtcctaatgcctgtttacaatgcaaattttaccccgaatatatatttaactctacatttgttctttgagaaaggtaaggttgttgagcatagttttatcttttcgttcttagatccaccatgcttttggtggtgtgcatgtaaatgttcactgagcgtctactgaaaaagtgtttatagtgtttttaacacatcacatattttgaagggaaaaaaaatatgggcatacaaatagttgtttaactcatttctttctagggccatggagttggggagagaatgtctaaatctctgggggtaagtagtggttgtgttgctttcttttgagggtaatactgttacagtgagatacatgttctcttctcccagactattctgtgattccttgcttctataaatggtactacccctaaactgtaaaagtttggctaaaattctagttcttttttatgccccacaggtatgaacgggtagatgaaattatttgggtgaagacaaatcaactgcaacgcatcattcggacaggccgtacaggtcactggttgaaccatgggaaggaacactgcttggtgagcagcagtggggcccaattcaataggtggagcacaaagaagaatcatttgatttcttactgagaaaaagttcaaaggtgtggtttcataaggtaatctgttatctgtggtgagcaggttggtgtcaaaggaaatccccaaggcttcaaccagggtctggattgtgatgtgatcgtagctgaggtatgtgcttcccaggcctccaaagcttccacatttttgttggtatcagttattcatgttgggtgtattctcatcccagatttttctcatttagatcataaacataatagaaagggctagaattgcaatcttgtgtaacttaaaaagcagctagtttttatttcctaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagt

SEQ ID NO: 358757 - DNA, 1219 bp, Homo sapiens
tctactgagtcctaatgcctgtttacaatgcaaattttaccccgaatatatatttaactctacatttgttctttgagaaaggtaaggttgttgagcatagttttatcttttcgttcttagatccaccatgcttttggtggtgtgcatgtaaatgttcactgagcgtctactgaaaaagtgtttatagtgtttttaacacatcacatattttgaagggaaaaaaaatatgggcatacaaatagttgtttaactcatttctttctagggccatggagttggggagagaatgtctaaatctctgggggtaagtagtggttgtgttgctttcttttgagggtaatactgttacagtgagatacatgttctcttctcccagactattctgtgattccttgcttctataaatggtactacccctaaactgtaaaagtttggctaaaattctagttcttttttatgccccacaggtatgaacgggtagatgaaattatttgggtgaagacaaatcaactgcaacgcatcattcggacaggccgtacaggtcactggttgaaccatgggaaggaacactgcttggtgagcagcagtggggcccaattcaataggtggagcacaaagaagaatcatttgatttcttactgagaagttggtgtcaaaggaaatccccaaggcttcaaccagggtctggattgtgatgtgatcgtagctgaggtatgtgcttcccaggcctccaaagcttccacatttttgttggtatcagttattcatgttgggtgtattctcatcccagatttttctcatttagatcataaacataatagaaagggctagaattgcaatcttgtgtaacttaaaaagcagctagtttttatttcctaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagt

SEQ ID NO: 358758 - DNA, 2424 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggttggtgtcaaaggaaatccccaaggcttcaaccagggtctggattgtgatgtgatcgtagctgaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagttgggattctgaagtccattctggctctgctacttaacagtgtataatcttgtgcaactcatctctcagtattatatgtgaaatgggagtattacctcattgggttgctgtgaaggttcaaactaaatgagtgcatgggaaacattaaaatgatcattataggctaggcacagtggctcacacctgtaatccgagcactttgggaagccgaggtaggagggtaactgtagcccaggagttcaagactagactgggcaacatagtgagaccccatctctactgctaccctccaaaaccattaaaaaaacaggaatgcaggctgggtgcggtggctcatgcctgtaatcccagcactttgggaggtcaaggcgggcggatcatgaggtcaggagttcgagaccagcctggccaacatggtgaaaccctgtctcta

SEQ ID NO: 358759 - DNA, 2712 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggtgagcagcagtggggcccaattcaataggtggagcacaaagaagaatcatttgatttcttactgagaaaaagttcaaaggtgtggtttcataaggtaatctgttatctgtggtgagcaggttggtgtcaaaggaaatccccaaggcttcaaccagggtctggattgtgatgtgatcgtagctgaggtatgtgcttcccaggcctccaaagcttccacatttttgttggtatcagttattcatgttgggtgtattctcatcccagatttttctcatttagatcataaacataatagaaagggctagaattgcaatcttgtgtaacttaaaaagcagctagtttttatttcctaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagttgggattctgaagtccattctggctctgctacttaacagtgtataatcttgtgcaactcatctctcagtattatatgtgaaatgggagtattacctcattgggttgctgtgaaggttcaaactaaatgagtgcatgggaaacattaaaatgatcattataggctaggcacagtggctcacacctgtaatccgagcactttgggaagccgaggtaggagggtaactgtagcccaggagttcaagactagactgggcaacatagtgagaccccatctctactgctaccctccaaaaccattaaaaaaacaggaatgcaggctgggtgcggtggctcatgcctgtaatcccagcactttgggaggtcaaggcgggcggatcatgaggtcaggagttcgagaccagcctggccaacatggtgaaaccctgtctcta

SEQ ID NO: 358760 - DNA, 2878 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcaggtctcttggaagggaatgaggtgggatgggtttgtcagaagcagccattccttttcagcatattccttccagtcattggggttctgtctgtaatcttatttagtttatggtttgtgtaagtcctccagaccctgaaggtgtactttcagaagtgcattgtgtgggaagaatacaggctgtactcccaaataactgagattttttttttaaaagctccctccctcttagaatagcaaagtatgtctgtctctgagccacagtgaaagttaaagtactctgaaaggaggataatcttaggagaaaaggaacctaaactcttaggtcagtgttttattctgttctacccaagtctcctgcactgcttgccttccagtggtaaaacaggaaaccaagtctttactcagagaggaattacaattgttctgtagtatgaattatggatttccatgctacctgcctcccttaaaactcttgaaggaagctctaatgatagaattaggggagggtaataaaatagacattttgaaatcatttggaatttgaactgttggatctacatctggagcaccatcttgattctccctttttattttcccagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggtgagcagcagtggggcccaattcaataggtggagcacaaagaagaatcatttgatttcttactgagaaaaagttcaaaggtgtggtttcataaggtaatctgttatctgtggtgagcaggttggtgtcaaaggaaatccccaaggcttcaaccagggtctggattgtgatgtgatcgtagctgaggtatgtgcttcccaggcctccaaagcttccacatttttgttggtatcagttattcatgttgggtgtattctcatcccagatttttctcatttagatcataaacataatagaaagggctagaattgcaatcttgtgtaacttaaaaagcagctagtttttatttcctaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagt

SEQ ID NO: 358761 - DNA, 1913 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggttggtgtcaaaggaaatccccaaggcttcaaccagggtctggattgtgatgtgatcgtagctgaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagt

SEQ ID NO: 358762 - DNA, 2078 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacggtaatgacctgacagagttaggatttaccacttattttcagttcacggtcagtgtcttattgcccatacctcccctcgttctctagccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggttggtgtcaaaggaaatccccaaggcttcaaccagggtctggattgtgatgtgatcgtagctgaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagt

SEQ ID NO: 358763 - DNA, 1778 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggttggtgtcaaaggaaatccccaaggcttcaaccagggtctggattgtgatgtgatcgtagctgaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagt

SEQ ID NO: 358764 - DNA, 444 bp, Homo sapiens
gctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggcagcagacgttcgcccttctgcaagtagttcgcggttcctcctcacgctgggcctcggttcttccagctcacttttaccggacggacgcttgagccccaccctcgtccgccttgcccactcctcttcagactgcgaggacgtcgcctttgtgaggctgctcagccccctatcccgcgaagcagcaagaacccctttttgttgctgctttg

SEQ ID NO: 358765 - DNA, 2252 bp, Homo sapiens
agggagggtgtgacgctggtatctgtgtgaactcgggcttgtgatgctgagcttggttcatctgctttctcctcccttttcctccccactccttcccaccagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggttggagactacaatgaaccattgactggtttttcatggagaggtggatctgaacgagagaccacaggaattcagatatggagtgaaatcttccttatcaataaacctgatggtaaaaaggttgcagtgttattgatggatactcagggaacctttgatagtcagtcaactttgagagattcagccacagtatttgcccttagcacaatgatcagctcaatacaggtatataacttatcccaaaatgtccaggaggatgatcttcagcacctccagcttttcactgagtatggcagactggcaatggaggaaacattcctgaagccatttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacatccattcctgtttcaccaacatttcctgttttctgctacctcatcctggcttaaaagtagctaccaatccaaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaaggcttatataaagatctatcaaggtgaagaattaccacatcccaaatccatgttacaggccacagcagaagctaacaatttagcagccgtggcaactgccaaggacacatacaacaaaaaaatggaagagatttgtggtggtgacaaaccatttctggccccaaatgacttgcagaccaaacacctgcaacttaaggaagaatctgtgaagctattccgaggggtgaagaagatgggtggggaagaatttagccggcgttacctgcagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccagggaagtacaaatgaggctttgtacaagctttacagtgcagcagcaacccacagacatctgtatcatcaagctttccctacaccaaagtcggaatctactgaacaatcagaaaagaaaaaaatgtaatgcaaattttaagaaatacaggtgcatgaccaattgtcaattaaatattcagttttatgtctccatgcaaacattcaaagtgcttccatcagaacggagtaaaatactaaacacctctgaagactgcaaactggattagttcttttacttcagtgtttaataagcagatgtatgtatgcatggttatactattttgttaacatgtacaatttcctgatttttcttcaaaaatgctgttataaagtatttgtctatttatgataacagtacacgtgttctgcttgaatttactaaattctactactgggttataattaaatcatgtgatattcca

SEQ ID NO: 358766 - DNA, 3348 bp, Homo sapiens
tgccgtcgccgccgccgccactcagccgctgcacggcgcgtcctctcgggggcggcggaggcgcgtacagtcgccgccgccgccgccgccgcaccacgttccccacccggggctgcgtcaccgggagacacgttcccagccagcatgggtcggcgcccagcggcccgcccgagcactccggccgcagaaccagagtgccgccctgaggcctgctgagaacacaacaccctcccgaccgcgccaccgcgcccccctagccgggcgcgtccttgcagggcctgggctgtctccctcccactctcagaaataaggcacacgcctgggcattcgtgggccaacgggccttggctaaaccgtccccacatttgtcagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggttggagactacaatgaaccattgactggtttttcatggagaggtggatctgaacgagagaccacaggaattcagatatggagtgaaatcttccttatcaataaacctgatggtaaaaaggttgcagtgttattgatggatactcagggaacctttgatagtcagtcaactttgagagattcagccacagtatttgcccttagcacaatgatcagctcaatacaggtatataacttatcccaaaatgtccaggaggatgatcttcagcacctccagcttttcactgagtatggcagactggcaatggaggaaacattcctgaagccatttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacatccattcctgtttcaccaacatttcctgttttctgctacctcatcctggcttaaaagtagctaccaatccaaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaaggcttatataaagatctatcaaggtgaagaattaccacatcccaaatccatgttacaggccacagcagaagctaacaatttagcagccgtggcaactgccaaggacacatacaacaaaaaaatggaagagatttgtggtggtgacaaaccatttctggccccaaatgacttgcagaccaaacacctgcaacttaaggaagaatctgtgaagctattccgaggggtgaagaagatgggtggggaagaatttagccggcgttacctgcagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccagggaagtacaaatgaggctttgtacaagctttacagtgcagcagcaacccacagacatctgtatcatcaagctttccctacaccaaagtcggaatctactgaacaatcagaaaagaaaaaaatgtaatgcaaattttaagaaatacaggtgcatgaccaattgtcaattaaatattcagttttatgtctccatgcaaacattcaaagtgcttccatcagaacggagtaaaatactaaacacctctgaagactgcaaactggattagttcttttacttcagtgtttaataagcagatgtatgtatgcatggttatactattttgttaacatgtacaatttcctgatttttcttcaaaaatgctgttataaagtatttgtctatttatgataacagtacacgtgttctgcttgaatttactaaattctactactgggttataattaaatcatgtgatattccacgtttggatatgctcatttaatttctacagaaaaaattttaaattatttcacattagccatttgttaaaacacagcatcataactcagcaggctggatttaatctgtatcatcttatatatatcacaatcttatttttaagcacattttagagttccttagttgctttatcaaaaaccagatattgcttttacatggtttaatagaatataaacctcttgataaaaaatgcacaaaaaatcactttgtatatgtgagtttcactgcattgtatattttttcatttggtacacaaagaatgtattcttcataggtttattcttttaatatgtgaactattattaaagtttactctggttcctaagattaaaaacaaatgcttactgaatttgaaaatgagaggtgctgatatagaatgatgaaggtttatctctttttttagactcaagatgcattttatttaatgttgacatcagtacaaacttaagtttctattttacaaaacatgctaattcctttaggtaacttctagttcttaatgactaaaatctctagtggagtttcactgaacagacttcttagaggaagaaggaaagtgtgttaatgaaaaaagtaatacttatctaggaggtccaaaacagagaaacttctaaagactgtcacagaaatggctacaccataattaagtagcgatataaagtaagaagtgacaggaaagaacaattaagatagaggagtgtgggagttcataagatatatatactgacatcttagaaaagtctgatcacaagttcagcaaattatcttttcccagtgataaaattcca

SEQ ID NO: 358767 - DNA, 1196 bp, Homo sapiens
  misc_feature (11)..(11): n is a, c, g, or t
atcgagctcgntccgtagctcgatcaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaaggcttatataaagatctatcaaggtgaagaattaccacatcccaaatccatgttacaggccacagcagaagctaacaatttagcagccgtggcaactgccaaggacacatacaacaaaaaaatggaagagatttgtggtggtgacaaaccatttctggccccaaatgacttgcagaccaaacacctgcaacttaaggaagaatctgtgaagctattccgaggggtgaagaagatgggtggggaagaatttagccggcgttacctgcagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccagggaagtacaaatgaggctttgtacaagctttacagtgcagcagcaacccacagacatctgtatcatcaagctttccctacaccaaagtcggaatctactgaacaatcagaaaagaaaaaaatgtaatgcaaattttaagaaatacaggtgcatgaccaattgtcaattaaatattcagttttatgtctccatgcaaacattcaaagtgcttccatcagaacggagtaaaatactaaacacctctgaagactgcaaactggattagttcttttacttcagtgtttaataagcagatgtatgtatgcatggttatactattttgttaacatgtacaatttcctgatttttcttcaaaaatgctgttataaagtatttgtctatttatgataacagtacacgtgttctgcttgaatttactaaattctactactgggttataattaaatcatgtgatattcca

SEQ ID NO: 358768 - DNA, 2522 bp, Homo sapiens
tgccgtcgccgccgccgccactcagccgctgcacggcgcgtcctctcgggggcggcggaggcgcgtacagtcgccgccgccgccgccgccgcaccacgttccccacccggggctgcgtcaccgggagacacgttcccagccagcatgggtcggcgcccagcggcccgcccgagcactccggccgcagaaccagagtgccgccctgaggcctgctgagaacacaacaccctcccgaccgcgccaccgcgcccccctagccgggcgcgtccttgcagggcctgggctgtctccctcccactctcagaaataaggcacacgcctgggcattcgtgggccaacgggccttggctaaaccgtccccacatttgtcagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggttggagactacaatgaaccattgactggtttttcatggagaggtggatctgaacgagagaccacaggaattcagatatggagtgaaatcttccttatcaataaacctgatggtaaaaaggttgcagtgttattgatggatactcagggaacctttgatagtcagtcaactttgagagattcagccacagtatttgcccttagcacaatgatcagctcaatacaggtatataacttatcccaaaatgtccaggaggatgatcttcagcacctccagcttttcactgagtatggcagactggcaatggaggaaacattcctgaagccatttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacatccattcctgtttcaccaacatttcctgttttctgctacctcatcctggcttaaaagtagctaccaatccaaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaaggcttatataaagatctatcaaggtgaagaattaccacatcccaaatccatgttacaggccacagcagaagctaacaatttagcagccgtggcaactgccaaggacacatacaacaaaaaaatggaagagatttgtggtggtgacaaaccatttctggccccaaatgacttgcagaccaaacacctgcaacttaaggaagaatctgtgaagctattccgaggggtgaagaagatgggtggggaagaatttagccggcgttacctgcagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccagggaagtacaaatgaggctttgtacaagctttacagtgcagcagcaacccacagacatctgtatcatcaagctttccctacaccaaagtcggaatctactgaacaatcagaaaagaaaaaaatgtaatgcaaattttaagaaatacaggtgcatgaccaattgtcaattaaatattcagttttatgtctccatgcaaacattcaaagtgcttccatcagaacggagtaaaatactaaacacctctgaagactgcaaactggattagttcttttacttcagtgtttaataagcagatgtatgtatgcatggttatactattttgttaacatgtacaatttcctgatttttcttcaaaaatgctgttataaagtatttgtctatttatgataacagtacacgtgttctgcttgaatttactaaattctactactgggttataattaaatcatgtgatattcca

SEQ ID NO: 358769 - DNA, 2394 bp, Homo sapiens
tgccgtcgccgccgccgccactcagccgctgcacggcgcgtcctctcgggggcggcggaggcgcgtacagtcgccgccgccgccgccgccgcaccacgttccccacccggggctgcgtcaccgggagacacgttcccagccagcatgggtcggcgcccagcggcccgcccgagcactccggccgcagaaccagagtgccgccctgaggcctgctgagaacacaacaccctcccgaccgcgccaccgcgcccccctagccgggcgcgtccttgcagggcctgggctgtctccctcccactctcagaaataaggcacacgcctgggcattcgtgggccaacgggccttggctaaaccgtccccacatttgtcagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggttggagactacaatgaaccattgactggtttttcatggagaggtggatctgaacgagagaccacaggaattcagatatggagtgaaatcttccttatcaataaacctgatggtaaaaaggttgcagtgttattgatggatactcagggaacctttgatagtcagtcaactttgagagattcagccacagtatttgcccttagcacaatgatcagctcaatacaggtatataacttatcccaaaatgtccaggaggatgatcttcagcacctccagcttttcactgagtatggcagactggcaatggaggaaacattcctgaagccatttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacatccattcctgtttcaccaacatttcctgttttctgctacctcatcctggcttaaaagtagctaccaatccaaactttgatggaaaattgaaaggcttatataaagatctatcaaggtgaagaattaccacatcccaaatccatgttacaggccacagcagaagctaacaatttagcagccgtggcaactgccaaggacacatacaacaaaaaaatggaagagatttgtggtggtgacaaaccatttctggccccaaatgacttgcagaccaaacacctgcaacttaaggaagaatctgtgaagctattccgaggggtgaagaagatgggtggggaagaatttagccggcgttacctgcagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccagggaagtacaaatgaggctttgtacaagctttacagtgcagcagcaacccacagacatctgtatcatcaagctttccctacaccaaagtcggaatctactgaacaatcagaaaagaaaaaaatgtaatgcaaattttaagaaatacaggtgcatgaccaattgtcaattaaatattcagttttatgtctccatgcaaacattcaaagtgcttccatcagaacggagtaaaatactaaacacctctgaagactgcaaactggattagttcttttacttcagtgtttaataagcagatgtatgtatgcatggttatactattttgttaacatgtacaatttcctgatttttcttcaaaaatgctgttataaagtatttgtctatttatgataacagtacacgtgttctgcttgaatttactaaattctactactgggttataattaaatcatgtgatattcca

SEQ ID NO: 358770 - DNA, 1211 bp, Homo sapiens
tgccgtcgccgccgccgccactcagccgctgcacggcgcgtcctctcgggggcggcggaggcgcgtacagtcgccgccgccgccgccgccgcaccacgttccccacccggggctgcgtcaccgggagacacgttcccagccagcatgggtcggcgcccagcggcccgcccgagcactccggccgcagaaccagagtgccgccctgaggcctgctgagaacacaacaccctcccgaccgcgccaccgcgcccccctagccgggcgcgtccttgcagggcctgggctgtctccctcccactctcagaaataaggcacacgcctgggcattcgtgggccaacgggccttggctaaaccgtccccacatttgtcagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggttggagactacaatgaaccattgactggtttttcatggagaggtggatctgaacgagagaccacaggaattcagatatggagtgaaatcttccttatcaataaacctgatggtaaaaaggttgcagtgttattgatggatactcagggaacctttgatagtcagtcaactttgagagattcagccacagtatttgcccttagcacaatgatcagctcaatacaggtatgaaataagcccattttgatgatgtttctttaactaaaaattatgagtatatgtgtttctacatacatgttataattagataaacaacagaaattgggaatcatatatattgtttgactcaattagcatacgagttctcgtgatttctgtgagagtggaattgtttttgttactg

SEQ ID NO: 358771 - DNA, 845 bp, Homo sapiens
cccacagttattcaagctccgcgttttgggatcatacatcttccaagatgaccttacatcatctaccaggttaataaaccagttttgttaagatccctacactcagcaccatgctttaaaaacctttaaacctaccaacctataaacggaaaaaaaaaacagtaagctgaatagctcaatgacaagtgatatgacagcttaagatatattctaaaacgagtggcaagcaacctactttgaggcatgttttgggggactggccttatgaaaaaggtgagaatttgattttgttcttcagctgaagcctaggactgtgaacagggtggttatatacctttcattccagcagcagttgccagcctactgtgtacaggcactagagccccatgctgagcaggttgagcacacagtgctgctgcttggagtatctgcgtggatatgcctgagaagcatgggtctgatggttattctgggacataaaggagacagaccagaggcaaagaggccagtgaggactgctctgtgcagttgtccaggcctgaagaaggtggcggtgatttgaatcagaagaggtggcattctcttcattaggaggatatggataatcaagacctaacaaattgggctccgaaagataccttcgtcatggggaagagtgaatggagagaagataatataaaatgccaaacgtatataaattgaaaggggaaaattgagagaacttgcgatccatggtcttggtcttccataaaggggaactgggacatccactggagcagagcacaggtataagcgtgcatgtcagggatttgggagactgactgtagtgtagtggatgggctaag

SEQ ID NO: 358772 - DNA, 534 bp, Homo sapiens
aacgctatctggggaagagtgaatggagagaagataatataaaatgccaaacgtatatcaatgaaaggggaaaagtgagagaacttgcgatccatggtctggtcttccataaaggggaactgggacatccactggagcagagcacaggtataagcgtgcatgtcagggattggggagactgactggcacgcttatacctgaggactgctctgtgcagttgtccaggcctgaagaaggtggcggtgatttgaatcagaagaggtggcattctcttcattaggaggatatggataatcaagacctaacaaattgggctccgaaagataccttcgtcatggggaagagtgaatggagagaagataatataaaatgccaaacgtatataaattgaaaggggaaaattgagagaacttgcgatccatggtcttggtcttccataaaggggaactgggacatccactggagcagagcacaggtataagcgtgcatgtcagggatttgggagactgactgtagtgtagtggatgggctaag

SEQ ID NO: 358773 - DNA, 4281 bp, Homo sapiens
atagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtggtgaggagtgggtttcgggcatgagaagtcacagggccgtttcctagtctctcttcacttctttgggtcttctcagagaaagaaggctgccgtgggtaggctgggggcggagactatcgggaagagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttacatgaagcctttttaaataaatgagtcaaagcacttgta

SEQ ID NO: 358774 - DNA, 4344 bp, Homo sapiens
gctggggtgggtaggttgggggtggagacaattaggaagaggtaggctagctctttttatcttttagtgcgttacatcctgtttctgtcagactttgttaaagacagtaaatgaatgtatgagtgagtcaaggaaaaacatctaaaaacatgaatacataaaattaagagggatagagtgtaatattatggccatttggaggaaaaaaactctgtctgtacctgtgtctatatgggtatggggttgctgttccaaagtgcattcatgaaagatgtggatgtagggcttgggcaaaacctcgaagactaaaatttggaagtaatacaataggaagtgaaatacagatccaggagacggatttgatacagaaggttcagaggaagtagttgttttgttagattttagaagaactaagggaaagaactcttctctgtatacagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttacatgaagcctttttaaataaatgagtcaaagcacttgta

SEQ ID NO: 358775 - DNA, 4828 bp, Homo sapiens
atagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtggtgaggagtgggtttcgggcatgagaagtcacagggccgtttcctagtctctcttcacttctttgggtcttctcagagaaagaaggctgccgtgggtaggctgggggcggagactatcgggaagagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggtcagtccatttttttcatcaaattacatacatagaacaggtaataatacagctacagtaattcacatccaggaattttgaccgttggtaatgtcatgtggtttaaccccatttgttcacactgatgaatgttaacttgtaaagctgtcaaggtctgagagctccccactcaccactttctttgcccgctcattctcatcaacaaagggttgttttgttccaagggcttccttagatgttagacatataaaacccctaagttttagtgccataaattccatgtgaaaactcaggctgttggggagctcatttcttaaagcctagcataaacaaagttacataatagtaaatgatatatataaacagtaaaagcaatattatatttttcatttggaaagaaaaaatactaatttttgaaaataggtagaaactgagggaaaagaatgatcttaactggtattcgagaccttgataatgccaacacttagaatattaccaattttagtagtagtttgctgcctcatctttcttctttttcccctaataggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttacatgaagcctttttaaataaatgagtcaaagcacttgta

SEQ ID NO: 358776 - DNA, 3591 bp, Homo sapiens
atagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtggtgaggagtgggtttcgggcatgagaagtcacagggccgtttcctagtctctcttcacttctttgggtcttctcagagaaagaaggctgccgtgggtaggctgggggcggagactatcgggaagagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgccctcaaactgaggtttaattttgacctatactgtcatcttcagatcagattgtcatcatcagg

SEQ ID NO: 358777 - DNA, 2991 bp, Homo sapiens
atagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtggtgaggagtgggtttcgggcatgagaagtcacagggccgtttcctagtctctcttcacttctttgggtcttctcagagaaagaaggctgccgtgggtaggctgggggcggagactatcgggaagagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaaagtctatgggtaaaacatcagggaagccaacagggtcagagctcccgtcggggctcagcggaaacgaatctgactcgtatagaccgctctaccg

SEQ ID NO: 358778 - DNA, 1500 bp, Homo sapiens
ttaactaacaaagtatctggaacagttgacacataaatgaagtgtggatgcatgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttacatgaagcctttttaaataaatgagtcaaagcacttgta

SEQ ID NO: 358779 - DNA, 1216 bp, Homo sapiens
aaacacaagaatgaacagaacctggagactaaccttcatttagaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttacatgaagcctttttaaataaatgagtcaaagcacttgta

SEQ ID NO: 358780 - DNA, 522 bp, Homo sapiens
atcctagaggatcccccgccatttacaactatctacttttggctctgcgatgatggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttacatgaagcctttttaaataaatgagtcaaagcacttgta

SEQ ID NO: 358781 - DNA, 1192 bp, Homo sapiens
atagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatccatttttcacgttatccagagggacagcagtgatgaagagaattccagtatcgtataactcagcaggtttaggtccattccatttggcatcagcagacatggtagcactttactggtatgtctgttttaaataaaacaaaatggaaaggtggaacattacaaattcaactagcaaaagaaagctttctgcacagcagttgccagcctactgtgtacaggcactagagccccatgctgagcaggttgagcacacagtgctgctgcttggagtatctgcgtggatatgcctgagaagcatgggtctgatggttattctgggacataaaggagacagaccagaggcaaagaggccagtgaggactgctctgtgcagttgtccaggcctgaagaaggtggcggtgatttgaatcagaagaggtggcattctcttcattaggaggatatggataatcaagacctaacaaattgggctccgaaagataccttcgtcatggggaagagtgaatggagagaagataatataaaatgccaaacgtatataaattgaaaggggaaaattgagagaacttgcgatccatggtcttggtcttccataaaggggaactgggacatccactggagcagagcacaggtataagcgtgcatgtcagggatttgggagactgactgtagtgtagtggatgggctaag

SEQ ID NO: 358782 - DNA, 385 bp, Homo sapiens
gctttcgatggcctccctaggatggtcatccagaggataagccaacgcacatcatcttcggttctgacagtgaatgtgaaacagaggagacatcgactcaggagcagagccatccaggagaggaatgggtgaaagtaagaagttcaggatgtctctgtggacattcatctacttctgcagatccacaccacaaacaactggcaatctcaacataaaaccctcctgagagccccaatgagacccagggcttgccaggtcacctcatattgagactacaggggtcttggagatttttatatatgaacctatattctccacaacatctgcagcatgacatcaatattagtgaaacgctacaaaaactgttcttgcatgtaataactac

SEQ ID NO: 358783 - DNA, 502 bp, Homo sapiens
cgaggcgggtggatcacctgaggtcaggagttcaagaccagcctggctaaagtggtgaaaccccgtctctactaaaaatacaaaaattagctggttgtggtcatgggctcctgtaatcccagctacttgggaggctgaggcaggagaatcacttgaacctgggaggcggaggttgcagtgagcctacattgtgccattgcactccagcctgggcaacaggagtgaaactcttgtctcaaacaaaaaaaaaggaaaaaaaaaaaagaatatacaggtagaatgaccaggagagttgataagcttgttccagaccaatgaaatgtaacaagaacagatatattctaaaacgagtggcaagcaacctactttgaggcatgttttgggggactggccttatgaaaaaggtgagaatttgattttgttcttcagctgaagcctaggactgtgaacagggtggttatatacctttcattccagcagcagttgccagcctactgtgtac

SEQ ID NO: 358784 - DNA, 4155 bp, Homo sapiens
atagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttacatgaagcctttttaaataaatgagtcaaagcacttgta

SEQ ID NO: 358785 - DNA, 4412 bp, Homo sapiens
atagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtggtgaggagtgggtttcgggcatgagaagtcacagggccgtttcctagtctctcttcacttctttgggtcttctcagagaaagaaggctgccgtgggtaggctgggggcggagactatcgggaagagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttacatgaagcctttttaaataaatgagtcaaagcacttgtattttccagcctaggctttgtgtgaattataggctatttgaaattttatttctgattatgtcaaatacaccttccattttgtcatttttgtttaaactgataaattacaagtcaacattgagttttatactt

SEQ ID NO: 358786 - DNA, 4167 bp, Homo sapiens
atagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtggtgaggagtgggtttcgggcatgagaagtcacagggccgtttcctagtctctcttcacttctttgggtcttctcagagaaagaaggctgccgtgggtaggctgggggcggagactatcgggaagagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttacatgaagcctttttaaataaatgagtcaaagcacttgta

SEQ ID NO: 358787 - DNA, 2841 bp, Homo sapiens
atagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtggtgaggagtgggtttcgggcatgagaagtcacagggccgtttcctagtctctcttcacttctttgggtcttctcagagaaagaaggctgccgtgggtaggctgggggcggagactatcgggaagagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttgatggtcacccagaggataacccacaacatcatgttgcgatttacgcgttcggcacctc

SEQ ID NO: 358788 - DNA, 1534 bp, Homo sapiens
agtcaggaatttccacctgacctgccatttactcattcctggtagatgagtctgggttactggctttcaatgtgagggagaagattacgttatgaagggaaatactgcttgtttgcctctgctattaataaatgttgtgtttcttcacaggagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttacatgaagcctttttaaataaatgagtcaaagcacttgta

SEQ ID NO: 358789 - DNA, 1374 bp, Homo sapiens
tgactaatacagtggaaaagatcatgcagccataaaaaggaatcaagcatgacacatgctgtgacttggatgaaccttgaaaacattacgctgaaagaagccagacacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttacatgaagcctttttaaataaatgagtcaaagcacttgta

SEQ ID NO: 358790 - DNA, 990 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaa

SEQ ID NO: 358791 - DNA, 150 bp, Homo sapiens
gcggccgcctactactactactgctcgaattcaagcttctaacgatgtacggggtcatgaaaatgtactgtgctaactttcttttccatagtggaaacacttatttatagtcatcaaaaatagtgaataaaaaacacatttggaacctgg

SEQ ID NO: 358792 - DNA, 1528 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctggaaaaaaaaaaaacaaaaaacaacaaaacaaaacaaaacaaaacaaaaagaaacacacaacaaaaaagaaacagaaaagaagagaaaaaaaaaaaaaaagagaaagagagagagagagagagagagagagagcagaaagaaaaaaacaaaaaaaaaagaacagaagaaagaaaaagaaaaacaaacacacagagagaagaggaagagaagaagagaggagggggcgggagagaggagaggaggaacgagatgcacggagggagggcagagcgaggaggaggaagcagagcgaggggaggcacaacgcgaggggaagaggagagggagggagagaagaggggaaagagaggaacgatggaggagggaga

SEQ ID NO: 358793 - DNA, 1161 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctgg

SEQ ID NO: 358794 - DNA, 1357 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaaaaaaaaaaaaaacaaaaaacaacaaaacaaaacaaaacaaaacaaaaagaaacacacaacaaaaaagaaacagaaaagaagagaaaaaaaaaaaaaaagagaaagagagagagagagagagagagagagagcagaaagaaaaaaacaaaaaaaaaagaacagaagaaagaaaaagaaaaacaaacacacagagagaagaggaagagaagaagagaggagggggcgggagagaggagaggaggaacgagatgcacggagggagggcagagcgaggaggaggaagcagagcgaggggaggcacaacgcgaggggaagaggagagggagggagagaagaggggaaagagaggaacgatggaggagggaga

SEQ ID NO: 358795 - DNA, 1254 bp, Homo sapiens
tctgctgggcctcggtggcgcggagtcggggcgcgtggggtttgggggctcgaggcctgcggagttggggcgtttgggggtgcaggctctgcagaggcctgggggctgcagggcccccgcgtgaccttggggtgggttggggagcggccgtcgccacgcgggacggccccagcctccaggaactggtgcgggcggcgggtttcctccggctcggcccacttggggctccccactagtacggtgcatttattctttccgtcgcccacgcagcacttcattcattcggttcttacgtctggaaccgccactggcctctgtggcagaagctcgcgttccagcgtggggcacaggtcctagatgcgccgacccaggcggcggctttgttggctgcggtgtctggttgagtgcgggccgctgcagagccgcagtgctgtggggaacagtgaagagcagcgaaaagcttatgttttcttttccagtttgagtctagtggtgaagtcttgggtctcttacggacttctgggtgaccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaa

SEQ ID NO: 358796 - DNA, 886 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaagggggagtgcggagcgatttggtgcagagccggggaggcgtattggtgagcg

SEQ ID NO: 358797 - DNA, 1051 bp, Homo sapiens
tctgctgggcctcggtggcgcggagtcggggcgcgtggggtttgggggctcgaggcctgcggagttggggcgtttgggggtgcaggctctgcagaggcctgggggctgcagggcccccgcgtgaccttggggtgggttggggagcggccgtcgccacgcgggacggccccagcctccaggaactggtgcgggcggcgggtttcctccggctcggcccacttggggctccccactagtacggtgcatttattctttccgtcgcccacgcagcacttcattcattcggttcttacgtctggaaccgccactggcctctgtggcagaagctcgcgttccagcgtggggcacaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttccagtgttttaatttcttgctcaggaagagaaactat

SEQ ID NO: 358798 - DNA, 715 bp, Homo sapiens
aatcaatttccataacttgtaactgaaagagccctgacttatacttagggaagtctctctggtgaagtgatctttgagctgaaggggctgatttggggccaggagtgagggtaggggatggtgagggggagcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaa

SEQ ID NO: 358799 - DNA, 889 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaa

SEQ ID NO: 358800 - DNA, 1936 bp, Homo sapiens
tctgctgggcctcggtggcgcggagtcggggcgcgtggggtttgggggctcgaggcctgcggagttggggcgtttgggggtgcaggctctgcagaggcctgggggctgcagggcccccgcgtgaccttggggtgggttggggagcggccgtcgccacgcgggacggccccagcctccaggaactggtgcgggcggcgggtttcctccggctcggcccacttggggctccccactagacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctgggccagatggcaggactgtgtgtgtacaggcccctgcgctgtgagcgccgctcgcctaagcctcccgggtgtatgtccaggcctgtccgcagcacaggtgggtgctgcacctcacggtagcctgggttcctgggagagacgccctggtgtctgaggtcgtgcatgtatcttgctgtgggccttgaagctgaggtgtctgagctggcgctggtgagggagcctggcc

SEQ ID NO: 358801 - DNA, 1108 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacaacgtgcctctgaactcagagcaggcccgcagcgaagcttagagcacacgggggtgtggagtcagccagacgggccctgatgggaggacgcagcgcccaggctgggctcgggacgaggatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaa

SEQ ID NO: 358802 - DNA, 785 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgtaagtaggctgatgtcccagaaataggactctttaaggttgaggttacaacttttatgggtgtccaggttttggcctgacttttaatcagactgaggctgcttaaagaaagggcctaaagttggtgactaatcccatgtggaaatttaacccgttcctttcatgaatcttcaccagatgcccttgctgccctgcagccagttgcatgaagggcatcccatcttgctgctctgtccactggcatggcggccccactgcccttttttgccactggcttctgaggatccagggagtcccttggttgagcagggggttttaagtttttgcagcatagacttctttggcatcgtgaagcttataaatcccccacccggtgtctg

SEQ ID NO: 358803 - DNA, 1049 bp, Homo sapiens
tctgctgggcctcggtggcgcggagtcggggcgcgtggggtttgggggctcgaggcctgcggagttggggcgtttgggggtgcaggctctgcagaggcctgggggctgcagggcccccgcgtgaccttggggtgggttggggagcggccgtcgccacgcgggacggccccagcctccaggaactggtgcgggcggcgggtttcctccggctcggcccacttggggctccccactagtacggtgcatttattctttccgtcgcccacgcagcacttcattcattcggttcttacgtctggaaccgccactggcctctgtggcagaagctcgcgttccagcgtggggcacaggtcctagatgcgccgacccaggcggcggctttgttggctgcggtgtctggttgagtgcgggccgctgcagagccgcagtgctgtggggaacagtgaagagcagcgaaaagcttatgttttcttttccagtttgagtctagtggtgaagtcttgggtctcttacggacttctgggtgaccaaggacactcatgaggaccatgatacttccactgagaatacagacgagtccaaccatgaccctcagtttgagccaatagtttctcttcctgagcaagaaattaaaacactggaagaagatgaagaggaactttttaaaatgtaagtaggctgatgtcccagaaataggactctttaaggttgaggttacaacttttatgggtgtccaggttttggcctgacttttaatcagactgaggctgcttaaagaaagggcctaaagttggtgactaatcccatgtggaaatttaacccgttcctttcatgaatcttcaccagatgcccttgctgccctgcagccagttgcatgaagggcatcccatcttgctgctctgtccactggcatggcggccccactgcccttttttgccactggcttctgaggatccagggagtcccttggttgagcagggggttttaagtttttgcagcatagacttctttggcatcgtgaagcttataaatcccccacccggtgtctg

SEQ ID NO: 358804 - DNA, 315 bp, Homo sapiens
ggagggacaagaccctgaagatctgtgccaaccactacagtaggtggcatgaacgaccacctcgacagtccccagcagcttggcctgggacctttgggaagattcagggctgattgggaactggggagcgtgttatttcatggagtgcaagtttgtggtgtgtttgttgaatttaaaaccagaaatacgtttttcagacgtgcctctgaactcagagcaggcccgcagcgaagcttagagcacacgggggtgtggagtcagccagacgggccctgatgggaggacgcagcgcccaggctgggctcgggacgagga

SEQ ID NO: 358805 - DNA, 462 bp, Homo sapiens
ccaggcggcggctttgttggctgcggtgtctggttgagtgcgggccgctgcagagccgcagtgctgtggggaacagtgaagagcagcgaaaagcttatgttttcttttccagtttgagtctagtggtgaagtcttgggtctcttacggacttctgggtgaccaaggcatgtgttctggaagactcgaacctaaaatatgattattggtgctctcttatcctctaaattgggccaggatttcatgactttcaccggtacaatttatctagttattaacttagttttctgaactgtgaaaaaattgctggcagagctgtgaatccagtgtaaatactagcagtcctgtagcgacttttttcgttttactaagcaagagcacaactatttcctaattagtcaaaactgaaagagttacattttgctttaaagtaatatttcaaaatctatttcgacccatcattg

SEQ ID NO: 358806 - DNA, 1164 bp, Homo sapiens
aggccgggcagagccctggccaagaggggcgtcttgcgcccacactcacttggcaagtttctgcagcacctgctcgcactccagctgcttccgctcaagctgctcagcatagggcactgtccatagaggggtcaccacgtcggccactcgtgttactggtggctcactctcaccctcctgtcgcctcctcctggccatggggtcggccttgggccgggccaggcgcacactgagtgggcggcctttccagagggcaccatgcaaaacgcgcagggccttgtccctctctgcagcgctgcggaatgtcacaaaggcgcagggtggttgcccaaagagtttggttttgtggggctgcagaccaaagcggcccaggaagcgccggacgtcgctgaagctggcgtggcgaggcacgttctgcagctccagtttaaagatctcagaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaa

SEQ ID NO: 358807 - DNA, 948 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaa

SEQ ID NO: 358808 - DNA, 1386 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctgggccagatggcaggactgtgtgtgtacaggcccctgcgctgtgagcgccgctcgcctaagcctcccgggtgtatgtccaggcctgtccgcagcacaggtgggtgctgcacctcacggtagcctgggttcctgggagagacgccctggtgtctgaggtcgtgcatgtatcttgctgtgggccttgaagctgaggtgtctgagctggcgctggtgagggagcctggcc

SEQ ID NO: 358809 - DNA, 1072 bp, Homo sapiens
tctgctgggcctcggtggcgcggagtcggggcgcgtggggtttgggggctcgaggcctgcggagttggggcgtttgggggtgcaggctctgcagaggcctgggggctgcagggcccccgcgtgaccttggggtgggttggggagcggccgtcgccacgcgggacggccccagcctccaggaactggtgcgggcggcgggtttcctccggctcggcccacttggggctccccactagtacggtgcatttattctttccgtcgcccacgcagcacttcattcattcggttcttacgtctggaaccgccactggcctctgtggcagaagctcgcgttccagcgtggggcacaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaa

SEQ ID NO: 358810 - DNA, 1969 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctgggccagatggcaggactgtgtgtgtacaggcccctgcgctgtgagcgccgctcgcctaagcctcccgggtgtatgtccaggcctgtccgcagcacaggtgggtgctgcacctcacggtagcctgggttcctgggagagacgccctggtgtctgaggtcgtgcatgtatcttgctgtgggccttgaagctgaggtgtctgagctggcgctggtgagggagcctggcc

SEQ ID NO: 358811 - DNA, 1573 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaa

SEQ ID NO: 358812 - DNA, 1473 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctggaaaaaaaaaaaacaaaaaacaacaaaacaaaacaaaacaaaacaaaaagaaacacacaacaaaaaagaaacagaaaagaagagaaaaaaaaaaaaaaagagaaagagagagagagagagagagagagagagcagaaagaaaaaaacaaaaaaaaaagaacagaagaaagaaaaagaaaaacaaacacacagagagaagaggaagagaagaagagaggagggggcgggagagaggagaggaggaacgagatgcacggagggagggcagagcgaggaggaggaagcagagcgaggggaggcacaacgcgaggggaagaggagagggagggagagaagaggggaaagagaggaacgatggaggagggaga

SEQ ID NO: 358813 - DNA, 1646 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacaacgtgcctctgaactcagagcaggcccgcagcgaagcttagagcacacgggggtgtggagtcagccagacgggccctgatgggaggacgcagcgcccaggctgggctcgggacgaggatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctggaaaaaaaaaaaacaaaaaacaacaaaacaaaacaaaacaaaacaaaaagaaacacacaacaaaaaagaaacagaaaagaagagaaaaaaaaaaaaaaagagaaagagagagagagagagagagagagagagcagaaagaaaaaaacaaaaaaaaaagaacagaagaaagaaaaagaaaaacaaacacacagagagaagaggaagagaagaagagaggagggggcgggagagaggagaggaggaacgagatgcacggagggagggcagagcgaggaggaggaagcagagcgaggggaggcacaacgcgaggggaagaggagagggagggagagaagaggggaaagagaggaacgatggaggagggaga

SEQ ID NO: 358814 - DNA, 1682 bp, Homo sapiens
ggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacaacgtgcctctgaactcagagcaggcccgcagcgaagcttagagcacacgggggtgtggagtcagccagacgggccctgatgggaggacgcagcgcccaggctgggctcgggacgaggatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaaaaaaaaaaaaaacaaaaaacccgggggcctctaatggcgggggggggacaacacggggtcagtgaaagttggccagttggcaaagcgtgtgttcctgtgacccagctttctgggtcccagcggcgtcaactctgccgggttccctatagggaggcccgataaattcgaaaagccaggtacctgttagattcctgcacaacaccgggaatatcagcaaccacacacagagtctataaaaggggggtgatctaagacccatttggtgtaacaacatgtgttcgtcgtggcgaagtcttttctccatcgtcttctcttaatcattctctctcgtctacgatcgtcgctggtagtgtccatgtctcaatctctatgctccatcgactgtcaccatctagtaatatactaatattcagacaatatcaaatactctaacacactcaacgcataaaaaaaataagagacctgacccgacaactatcctatactactcgcccttccctcctccgatctcatcaacaatgggttccacaccctatcacaagacaacaccgttccaccaaacaacttgtaccgg

SEQ ID NO: 358815 - DNA, 199 bp, Homo sapiens
gtgtgcctcctagaacctagtgtacttttggttatactgtagaagaggcagcttcatcaagcttttagaaagcatgggaatggatgataaatcaaaggtagatacactgagagaagaggaatccgctggaggggaaccttgggatgtttctgcttttgcagctcatgcaacaacagatgagccagtgagagacaaaggc

SEQ ID NO: 358816 - DNA, 348 bp, Homo sapiens
atgagctaggatcgcaccactacactccaggcttggtgatagagcagcccgtatctcttaaaaaacaaacaaaaaaaagagcctgaaccttatcttcagagactaacttccctttaaggtgctaaaggtaatttatgagatcagtcaatcaagaaatatttatgaaattgagaatgagtccctctgtcaattgagtgcattctcctgttttcattcagtaaatatttactgagctcctccgcgtgccagatagaatttccagtaatgctttgcaaagaccatcgcactgcagtggatgagctgcagcaggcgctccacgcccactctcctcctgggcctgcactaggt

SEQ ID NO: 358817 - DNA, 381 bp, Homo sapiens
gatgtatttggtctttataggattgcttatggtaagtatcttcgttctttcaggctgctacaacaaatttccatagactgggtggattaagcaacaaaaatttttcctcacagttctggaggctgggaagttcaagatcaaggtaccagcaggtcctgtgtctggtgaggatctgctctctagtctggtgaggacctgccttctggtttgcagaaggttatattcttcttgtatccttaccagtgtagagcagagagaggaagcaagctctcatgtctctttttataagggcactgattacattcatgaaggctccaccctcatgacccaattacctccccaaagccctatctcctaaaaccataacattgagggttagga

SEQ ID NO: 358818 - DNA, 441 bp, Homo sapiens
aacattgcgtgaacacctaaataaaattcatttttaaaacaatatttactgatccagcactagaagctaagcctcctgatttctaacacagtatttatttttacttgcccctttcccccaaaataatattggctccttttctctctatacttccctaccctcccatgggatggagagatggaatgtgggaggcaaggccagtgtgagcactggctctgaggtttaggcctcgatattcaggagagtggtgtaggaggaagatgaaccactgggttttagacacatggaggcttagttcagggctttgggcctcccggttagtttgtttagtcttgttgatctaggaggagatcacaccagatgaaaggatacagttgactttggaggagggtgaagcagagctgggaaaagaatcagataagtcattagagacataaaaaa

SEQ ID NO: 358819 - DNA, 864 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgagacccctccttcattgtttcccctcatacatctccctctgccaaggagtgtgccccttttcctttctaccctagaataaacatctgggttctccagtcagac

SEQ ID NO: 358820 - DNA, 1065 bp, Homo sapiens
tccggtggtgacgtgtattcgcttcaccgggactaagttcctcctgcgcggtctatggcggactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgagacccctccttcattgtttcccctcatacatctccctctgccaaggagtgtgccccttttcctttctaccctagaataaacatctgggttctccagtcagaccttttttcatttttttgacttttttgtctgtttttttttttttttacttctccttaatgccatctaccatttgcttttttttctccaagttatttttttactcatttgtttcactcattcattcatttaacaaatcaatagtaaatatatacaatgtgtcaggtacaattctagataatggcaaaatacagactgactgtagctgggtccttgccttccaggagctcgaagtcccataaaagatggagataagtaaacaggcagttacaagatggtctgataaaggccatgatgatacaggcatgcacagggcaccttaaagaagggcactcttggccgggcgcggtggctcactcctgtaatc

SEQ ID NO: 358821 - DNA, 2368 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcagggattctagggatggggcagagtggcagcatcctttgtacctacaggtggtggatcccacaactcatttgacctttaaccttcacctgtccaagaaagagagagaagccagagatagcctgatcctgcccttccagttcagttctgaaaagtaaggttgggacctgggtacgtggatccctgagtagatcccagcatctgggccatggagaggttggggcaacaggttattgattaacctgactttatagggactgaagtccacctccagagacaagtccaagttcttgatccacccattccccctataatggcagaggacctttatgtctcttttctctcccttatacccttgggtcacagctccagttgtccccagagcaccctgggcctgggctgagccagaccagacccttgggaggtggccctatccctaggcagtggtgctaggaggacagaaggctatatgggcgtggcagaggctggttaacaagggcttagtacacgcttgctgttctgtgcccagtatgtgggcggatgacgcaagactacaagatccttgccctcaagctgctaggaacttacggttttattaggagagcagtacaagggtatctatcccagtaccaaatggtgcttcagctctaacatggaggtcagagaaagggacttggaccaataaaatgacatggaggcctaacaggttgcctgaatgagagtcacagtcacctggaagaaagtatccagacccaacctgttagctaccctcaccagcaccaaatcttcccttctcagacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaaaaagttttaaaaaaaaaggggggggctaaaaaaccccaggggccagttagcgttccgtttttgccagggcctagt

SEQ ID NO: 358822 - DNA, 2330 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcagggattctagggatggggcagagtggcagcatcctttgtacctacaggtggtggatcccacaactcatttgacctttaaccttcacctgtccaagaaagagagagaagccagagatagcctgatcctgcccttccagttcagttctgaaaagtaaggttgggacctgggtacgtggatccctgagtagatcccagcatctgggccatggagaggttggggcaacaggttattgattaacctgactttatagggactgaagtccacctccagagacaagtccaagttcttgatccacccattccccctataatggcagaggacctttatgtctcttttctctcccttatacccttgggtcacagctccagttgtccccagagcaccctgggcctgggctgagccagaccagacccttgggaggtggccctatccctaggcagtggtgctaggaggacagaaggctatatgggcgtggcagaggctggttaacaagggcttagtacacgcttgctgttctgtgcccagtatgtgggcggatgacgcaagactacaagatccttgccctcaagctgctaggaacttacggttttattaggagagcagtacaagggtatctatcccagtaccaaatggtgcttcagctctaacatggaggtcagagaaagggacttggaccaataaaatgacatggaggcctaacaggttgcctgaatgagagtcacagtcacctggaagaaagtatccagacccaacctgttagctaccctcaccagcaccaaatcttcccttctcagacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttttttttttttctttctttttcttttcttttcttttttttttttttt

SEQ ID NO: 358823 - DNA, 1495 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttattttttt

SEQ ID NO: 358824 - DNA, 1497 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcagggattctagggatggggcagagtggcagcatcctttgtacctacaggtgccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttattttttt

SEQ ID NO: 358825 - DNA, 1394 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccgacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttattttttt

SEQ ID NO: 358826 - DNA, 1229 bp, Homo sapiens
gcaggaagggccaggggtcacaggctaggtgtggaaatcgcgacgggttcgcgaaggcggtaatcccagcgctctcataccctttatccgtccctcgctctgcagattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaaaaagtactttggtag

SEQ ID NO: 358827 - DNA, 1144 bp, Homo sapiens
gaactataggctaggtagcgattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaaaaagtactttggtag

SEQ ID NO: 358828 - DNA, 1045 bp, Homo sapiens
ggtcatgctcagtgccaagatgctcctgagttagcttttccccattttggcactcagttcgtcgctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaaaaagtactttggtag

SEQ ID NO: 358829 - DNA, 1108 bp, Homo sapiens
cctcgggtgtgatttagtgacggggcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacacgtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaaaaagtactttggtag

SEQ ID NO: 358830 - DNA, 1452 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacacgtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcagggattctagggatggggcagagtggcagcatcctttgtacctacaggtgccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttattttttt

SEQ ID NO: 358831 - DNA, 1166 bp, Homo sapiens
agttcgacggagactctccagtggaaagagagagaagccagagatagcctgatcctgcccttccagttcagttctgaaaagtaaggttgggacctgggtacgtggatccctgagtagatcccagcatctgggccatggagaggttggggcaacaggttattgattaacctgactttatagggactgaagtccacctccagagacaagtccaagttcttgatccacccattccccctataatggcagaggacctttatgtctcttttctctcccttatacccttgggtcacagctccagttgtccccagagcaccctgggcctgggctgagccagaccagacccttgggaggtggccctatccctaggcagtggtgctaggaggacagaaggctatatgggcgtggcagaggctggttaacaagggcttagtacacgcttgctgttctgtgcccagtatgtgggcggatgacgcaagactacaagatccttgccctcaagctgctaggaacttacggttttattaggagagcagtacaagggtatctatcccagtaccaaatggtgcttcagctctaacatggaggtcagagaaagggacttggaccaataaaatgacatggaggcctaacaggttgcctgaatgagagtcacagtcacctggaagaaagtatccagacccaacctgttagctaccctcaccagcaccaaatcttcccttctcagacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaaaaagttttaaaaaaaaaggggggggctaaaaaaccccaggggccagttagcgttccgtttttgccagggcctagt

SEQ ID NO: 358832 - DNA, 1128 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacacgaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttattttttt

SEQ ID NO: 358833 - DNA, 1037 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtgtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttattttttt

SEQ ID NO: 358834 - DNA, 644 bp, Homo sapiens
gtgggagaatcacttgaacctgggaggcggaggttgaggtgagccgagatcatgccactacactccagcctgggcaacagagtgagactccgtctcaaaaaaggagtaagtgggctgctctgcctaaggagtcgccatccttttattcctttacttccttaatcaacttgctttcacttttgaaaataaaatagaggctgggcgcagtggcttacacctgtaatcccagcattttgggaggccgaagtgggcagatcacctgaggttagtggtttgagaccagcctggccaatatagcaaaaccccatctctactaaaaagacaaaaattagctgggtgtggtagcacgtgcctgtaatcccagctactcgggaggctgaggcaggagaatcacttgaacctgggaggcggaggttgcagtgagctaagatcacgccactgtactccagcctgggcaacaaagccagaccctgtctcaaaaaaaaaaaaaaaagttgagggcaggagctgaaagcagtcagttaaataggtgattgggggctgaggatgtgaggtcctggagtctgtctagtttcttcagtaagatgaaaaaaactcttttcttttttctctccaactcagtggttctccatccttccggactt

SEQ ID NO: 358835 - DNA, 1432 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaaaaagtactttggtag

SEQ ID NO: 358836 - DNA, 1519 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaaaaagtactttggtag

SEQ ID NO: 358837 - DNA, 2284 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcagggattctagggatggggcagagtggcagcatcctttgtacctacaggtggtggatcccacaactcatttgacctttaaccttcacctgtccaagaaagagagagaagccagagatagcctgatcctgcccttccagttcagttctgaaaagtaaggttgggacctgggtacgtggatccctgagtagatcccagcatctgggccatggagaggttggggcaacaggttattgattaacctgactttatagggactgaagtccacctccagagacaagtccaagttcttgatccacccattccccctataatggcagaggacctttatgtctcttttctctcccttatacccttgggtcacagctccagttgtccccagagcaccctgggcctgggctgagccagaccagacccttgggaggtggccctatccctaggcagtggtgctaggaggacagaaggctatatgggcgtggcagaggctggttaacaagggcttagtacacgcttgctgttctgtgcccagtatgtgggcggatgacgcaagactacaagatccttgccctcaagctgctaggaacttacggttttattaggagagcagtacaagggtatctatcccagtaccaaatggtgcttcagctctaacatggaggtcagagaaagggacttggaccaataaaatgacatggaggcctaacaggttgcctgaatgagagtcacagtcacctggaagaaagtatccagacccaacctgttagctaccctcaccagcaccaaatcttcccttctcagacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttattttttt

SEQ ID NO: 358838 - DNA, 1187 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaacaggaggtctctgggctagcagggcggtacgcctttttggcagttgagcg

SEQ ID NO: 358839 - DNA, 1356 bp, Homo sapiens
tccggtggtgacgtgtattcgcttcaccgggactaagttcctcctgcgcggtctatggcggactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaaaaagtactttggtag

SEQ ID NO: 358840 - DNA, 1263 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaacatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttattttttt

SEQ ID NO: 358841 - DNA, 2332 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcagggattctagggatggggcagagtggcagcatcctttgtacctacaggtggtggatcccacaactcatttgacctttaaccttcacctgtccaagaaagagagagaagccagagatagcctgatcctgcccttccagttcagttctgaaaagtaaggttgggacctgggtacgtggatccctgagtagatcccagcatctgggccatggagaggttggggcaacaggttattgattaacctgactttatagggactgaagtccacctccagagacaagtccaagttcttgatccacccattccccctataatggcagaggacctttatgtctcttttctctcccttatacccttgggtcacagctccagttgtccccagagcaccctgggcctgggctgagccagaccagacccttgggaggtggccctatccctaggcagtggtgctaggaggacagaaggctatatgggcgtggcagaggctggttaacaagggcttagtacacgcttgctgttctgtgcccagtatgtgggcggatgacgcaagactacaagatccttgccctcaagctgctaggaacttacggttttattaggagagcagtacaagggtatctatcccagtaccaaatggtgcttcagctctaacatggaggtcagagaaagggacttggaccaataaaatgacatggaggcctaacaggttgcctgaatgagagtcacagtcacctggaagaaagtatccagacccaacctgttagctaccctcaccagcaccaaatcttcccttctcagacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaaaaagttttaaaaaaaaaggggggggctaaaaaaccccaggggccagttagcgttccgtttttgccagggcctagt

SEQ ID NO: 358842 - DNA, 1303 bp, Homo sapiens
tccggtggtgacgtgtattcgcttcaccgggactaagttcctcctgcgcggtctatggcggactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaaaaagtactttggtag

SEQ ID NO: 358843 - DNA, 1228 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgagacccctccttcattgtttcccctcatacatctccctctgccaaggagtgtgccccttttcctttctaccctagaataaacatctgggttctccagtcagaccttttttcatttttttgacttttttgtctgtttttttttttttttacttctccttaatgccatctaccatttgcttttttttctccaagttatttttttactcatttgtttcactcattcattcatttaacaaatcaatagtaaatatatacaatgtgtcaggtacaattctagataatggcaaaatacagactgactgtagctgggtccttgccttccaggagctcgaagtcccataaaagatggagataagtaaacaggcagttacaagatggtctgataaaggccatgatgatacaggcatgcacagggcaccttaaagaagggcactcttggccgggcgcggtggctcactcctgtaatc

SEQ ID NO: 358844 - DNA, 1065 bp, Homo sapiens
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccaggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccgacagcaggctttctgcgcctatgcagggcagctaccagcacatcttttatgagcaatgctatgatgactggacccaagagacccaatg

SEQ ID NO: 358845 - DNA, 810 bp, Homo sapiens
ttttttgcctgtgtttatctatttcttggattatggaacagaacaaacatgaacacattaccttttgcctttcctcatttcccacactctttcctagaggtaatattaagcttccaattaattttagatggtagtttcaataattttttttcactgggtattacaagtcttcatttcaaccctctgagtttggtttacttgtccatttaatactaatttagtggatacgttttaggtgctgttatggcagacccaactcaagctggtgatttctatattacttggaatcgtgctagttgctttgacaactacactcaacaacatataatatcttaaacagaacagaagtttcattcatataaactgtttttttaagataggaaaagcattgctcctttatgtccgcattcaagaacataggctactaaggtatttaatctgcagtatgttgcttccaagactactgtagaattggccgttccagtcaagcatactgaaaaacgtatacagaagagtgcatgttgggattttggagactaaattggatataaaatatgttatttctactaattttccactattttgactttaatcccatgccctaatataaagtatataagaatgagaaacatagtttatgtatctatcaaaatagaacataaatgtttgtgaacatttgaatctgtcagcttctcttgctcacgtgcctgtagtgcctgtactcaggatgctgaggcaggagaatcacaaggtgaggagatcgagaccatcctggctaacatggtgaaactctatctctactaaaaatac

SEQ ID NO: 358846 - DNA, 3361 bp, Homo sapiens
cgcccgccagccagccctccccgcggcggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaaca

SEQ ID NO: 358847 - DNA, 277 bp, Homo sapiens
ggggaggctgcttcactgacctgagcgagcgagcatgggatctggatgaagtggtcatcgtggaggtaagagcaaagaggcggaaattaagagaatcaacaaggaactggccaacatccgctccaagttcaaagagagacaagagcctgtggatgcgctacgagtaagaaacaaatagtgtgtgtaaattggcttttcattcttccgtgcttggcctatgactattgacttgtgggcacagtggagggctgtgaattcgtgtcgagtttccaattaa

SEQ ID NO: 358848 - DNA, 3427 bp, Homo sapiens
cgcccgccagccagccctccccgcggcggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcgagctggagccgcctgcccccgagagccccatggctttgctggctgacccagctccagctgctgacccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaaca

SEQ ID NO: 358849 - DNA, 3102 bp, Homo sapiens
cgcccgccagccagccctccccgcggcggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaactgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaaca

SEQ ID NO: 358850 - DNA, 2961 bp, Homo sapiens
cgcccgccagccagccctccccgcggcggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaaca

SEQ ID NO: 358851 - DNA, 2674 bp, Homo sapiens
cgcccatctcccggctgcccacgttggcgaatgcagtgcagggccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaaca

SEQ ID NO: 358852 - DNA, 2146 bp, Homo sapiens
cgcccgccagccagccctccccgcggcggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctctctcccctcccaccccaccctgttgtagcccctcctaccccctccccatccaggggctgtgtattattgtgagcgaataaacagagagacgctaacagccccatgtctgtgtccatcacccactgctaggtagtcaaagaagtggggtgagggcatgcagagtgtgggtggccaggcttcgcagcccatgggtgggactctggggagacagcagcagcagcagccgccgaagccccagctgcaaggccaccagacgcactcctgtgcctggttcctcagtccccaacaccaggtagcaagctctgggcagctgggcctggtagacctcatcttctgtcttctctggtggccctggc

SEQ ID NO: 358853 - DNA, 1712 bp, Homo sapiens
cgcccgccagccagccctccccgcggcggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccaggtaaggctccctcagcctgcag

SEQ ID NO: 358854 - DNA, 679 bp, Homo sapiens
ggccgtccaggtccctgacttgaaccttcccggtccccagccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaaca

SEQ ID NO: 358855 - DNA, 419 bp, Homo sapiens
tctgccgatgcgggggcacgggccagggttctattcccattggaggccactgctggatggatgcgaggttcctcgaggctctgtgaggggtctggatatgtggttctggggttctgtccttagggcttgttctcgcactcaatcgctctgggcctttgcccctccccaccaagttccttcccatctcactctgctccatgcctccagcccaggtcctgaggacatcggccctcccattccggaagccgatgagttgctgaataagtgagtcctgggagtggtgggggaggggaacgggacaggtgcggagcccaggccaggtgcagacaggcacccccgtcatcttgcgccccctgccccctcaggtttgtgtgtaagaacaacggggtcctgttcgagaaccagctgctgcagatcgg

SEQ ID NO: 358856 - DNA, 444 bp, Homo sapiens
ggctaatttttttgtagagatggggtcttgccatgttgcccaggcttacacatgtccagaggctaagagaggttaagtggttgcccacagccactcaggtggttaagagctgggattcaaacccaagtcagcctccagagctaatactattatgtctcagtgcggtgtgacattgtggaaggccaaaggaggcacctagggggcgcctcagaggtttccatagtatgaactttgtagttgaaccttgtaggattgagtccaggattgcaccatggggtccctcaaagacctgcaggcgggagctgccgggagctctggggttcctgacccagacctcccgggggcccacctcctctgtctggcttccttgactcctggcgggcacagctggctgtgcagaccaagcgcgtggcggcgcaggtggacggcggcgcgcaggtgcag

SEQ ID NO: 358857 - DNA, 307 bp, Homo sapiens
tatcctttccacctttctctcatcttttataattttcttcctctctggcgcctctgttgatttcagtcttacatttttctctcctgtgtcttgtatcacctttctggcccctttatccttccttccttctatctcccttgggtcccgacttccctgggctccccatctcctctgagttctgcccccaatgcccccacccagatgtaccggctgaccctgcgcaccagcaaggagcccgtctcccgtcacctgtgtgagctgctggcacagcagttctgagccctggactctgccccgggggatgtgg

SEQ ID NO: 358858 - DNA, 3110 bp, Homo sapiens
cgcccgccagccagccctccccgcggcggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaacctggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaaca

SEQ ID NO: 358859 - DNA, 3620 bp, Homo sapiens
cgcccgccagccagccctccccgcggcggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaacagccccatgtctgtgtccatcacccactgctaggtagtcaaagaagtggggtgagggcatgcagagtgtgggtggccaggcttcgcagcccatgggtgggactctggggagacagcagcagcagcagccgccgaagccccagctgcaaggccaccagacgcactcctgtgcctggttcctcagtccccaacaccaggtagcaagctctgggcagctgggcctggtagacctcatcttctgtcttctctggtggccctggc

SEQ ID NO: 358860 - DNA, 3291 bp, Homo sapiens
cgcccgccagccagccctccccgcggcggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaaca

SEQ ID NO: 358861 - DNA, 2779 bp, Homo sapiens
acatcttaggctaggtacgaggctgggtggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaaca

SEQ ID NO: 358862 - DNA, 1887 bp, Homo sapiens
cgcccgccagccagccctccccgcggcggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctctctcccctcccaccccaccctgttgtagcccctcctaccccctccccatccaggggctgtgtattattgtgagcgaataaacagagagacgctaaca

SEQ ID NO: 358863 - DNA, 1201 bp, Homo sapiens
tctgctctgggattggatggctcagcgagctggagccgcctgcccccgagagccccatggctttgctggctgacccagctccagctgctgacccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaaca

SEQ ID NO: 358864 - DNA, 665 bp, Homo sapiens
cgcccgccagccagccctccccgcggcggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggccttgtacagtcgaaggaggcacaggccgcactctgcttgacactgtccaagctgcccccggccaccagatgcggggatgttagcggcaaag

SEQ ID NO: 358865 - DNA, 434 bp, Homo sapiens
ggaaactgaggctcacatggtgccacctcttgcccgagagggtcagagcaggaggagagcccaggtctggggatagatcttgtgtctccagaggtgccttgtctcaccatctctgctgggctgggaagaggttgagggagcagagaccctggccctgagctgcagaattctcgagtgtcagaggcaccccgagctcctcctttggaagacaggagctggggcatggccaccaccccagcaggtgtgccaggtgggcaggacactcagccgggggcgtccccttcgtttccccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatc

SEQ ID NO: 358866 - DNA, 529 bp, Homo sapiens
tttcttttttatttgagatggggtctcactatgttacccaggctggtcacaaactcctgggctcaagcgatcctctcacctcagcctcccgaatagctgggattatgggtgggtaccacagagcctggcttaggactatacactttaaaaggataaacttcatggtatgtgtattatgtctttaaaaagctgtttttttaaaaaaaaatgaattaaggaggttattatgtctccttagtttcctttaatgtaggagcccccaccttcactgactttcaggatgtggacatctgctcaaggctcaggccagagctcttagaaagagccctgatttgcaggggttcccacagtcctctgctgatcactgctcataatcagatccagttaaacctttctggcgagaatcacacaggcaatgctgtgccaaaagaatacttcagactatttctataccataagcgattggctctgtatgattaatatttgcaaagtcgtgtgtttgcagcactttatcttcatgtgttttcct

SEQ ID NO: 358867 - DNA, 480 bp, Homo sapiens
tatatggggtcttgaaggatatgtagaagtttgccaactgtaattaaaaggcagagcatggtggctcacgcctgtaatcccagcactttgggaggctgacgcgggaagattgcttaagcccaggattttgagaccaggctgggcaacatagtggaccccgtctctattatttaaaaatttaatttttaaaaaaatttaaaaataaagaaaaaaaatggttgtttaggctagtcatggtggctcatgcctgtaatcccagcactttgggaagctgaggcaggtggatcacctgaggtcaggagtttgagaccaacctggccaacatggcgaaaccccacctctactaaaatacaaaaattagccaggcatggcagtgcatgcctctaatcccagctactagggaggctgaggcaggagaatcgcttgaacctgggaggtggaaattgcagtgagccaagatcaagccactgcactccagcc

SEQ ID NO: 358868 - DNA, 337 bp, Homo sapiens
ggatgtattatacaatatattcttgctcgtctcggtgatacacaacacattagcatactaaaggctctgataaatcttcatgcaatgaaactcaattttgtttaatccataagttgctcaagcttaactatagaattctgcctctacccctgttcccagcataactaagggtctacagacaacactttgggaaatggactaaattatctttaacatcccctcctaggtttaaatttgcatagttctatgttagaggttttgttttttatttttttgagacaggttcttgctctgttgcccaggctggagtgcagtggcccgatctcggctcactgca

SEQ ID NO: 358869 - DNA, 144 bp, Homo sapiens
ttttcatttcatttcatttatttctaatcttatccttattgtttccttcctgctacttgctttcaagaatttttctctgtctttaagaagtttgattatgactcttcgcgagattgcatttcttttagatttgcttggtttctt

SEQ ID NO: 358870 - DNA, 1801 bp, Homo sapiens
gcgccggaagcagcctgggccgctgcgcagaggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagagcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaagaaaaaaaaaaaagaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaatcttgtttgtaaatatattgtctttctcttaatatttgctctgggtcaggaagaagctgttcacggtgtgataatactctttagattgtgctttcattattatagatgcatcatgtcttctgctttcacgtgtctgggatggggtcagaaatgcatcctccagctgacagaaaaatccaggatgagatcagaaggatactggtgttttctgacttttacaaaattacttgtttgttttcattaaaaaaaaagcataaactatgtttcttattactattagaattattaaatttcaaaatgaatcca

SEQ ID NO: 358871 - DNA, 1800 bp, Homo sapiens
  misc_feature (29)..(29): n is a, c, g, or t
ctttaaatatataggctaggtacgaggcngggtggtgcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagagcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaagaaaaaaaaaaaagaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaatcttgtttgtaaatatattgtctttctcttaatatttgctctgggtcaggaagaagctgttcacggtgtgataatactctttagattgtgctttcattattatagatgcatcatgtcttctgctttcacgtgtctgggatggggtcagaaatgcatcctccagctgacagaaaaatccaggatgagatcagaaggatactggtgttttctgacttttacaaaattacttgtttgttttcattaaaaaaaaagcataaactatgtttcttattactattagaattattaaatttcaaaatgaatcca

SEQ ID NO: 358872 - DNA, 1992 bp, Homo sapiens
gcgccggaagcagcctgggccgctgcgcagaggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagagcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaagaaaaaaaaaagatgctatagcttctgactgatcacgtaaaatgcgtgttccacgagagaacagagtcccccatgagtggggagagcaagtcctcgtagaaggacccccgtgttgcccttaataagtacccggcggggagtttcacagccgttaagttatagacctcttggaacaccagaagtatcgtgttgtacacatccccacatgagggggggcgcacccacgtatcctggtggggggcgactttttacacacccttggtgcggaaacatataatgtgcgcctccgcataatataatctgccacagggctacaggaaaagagactgtgccaggggagaagaaaaacacccccttagaatggcgcttcccactatattgaagagcgaccgcagataccctcagcggctaaccacgttcttcagcgaactagtgggcgtacaaaaaacttggagcctccccacaggtgggtaagaaaaaactccagggagggacaccacgaagagaactggggtgagtctcgagcgtcgttaaccacaacaactcgaggtgttggtctcttatacaaagacggcacacgacaagtgtccttgtctaatgcaaacattcaactttacgagcgactgcctacgaagaaaaaatcctccggggtgcccaccaaaaggggacgtcctagaggaggcagccaacacattggctct

SEQ ID NO: 358873 - DNA, 1212 bp, Homo sapiens
gcgccggaagcagcctgggccgctgcgcagaggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagagcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccacgccgtgttgatatgcattgcaggatacaagtttacatcaaggacagctatgcgatagtacaagtct

SEQ ID NO: 358874 - DNA, 1798 bp, Homo sapiens
ttcactccgggcaatcagctgtagctcaccatagtctaatagaaaataaccgtaaaccaaattatttaatgcactgcttattacaattttactgggtctctattttaccctcctacaagcctcacagtacttcgagtcccccccccggtacatgcaagatcggtacacccggttacattgcaaggcatgtaccgggggggttgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagagcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaagaaaaaaaaaaaagaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaatcttgtttgtaaatatattgtctttctcttaatatttgctctgggtcaggaagaagctgttcacggtgtgataatactctttagattgtgctttcattattatagatgcatcatgtcttctgctttcacgtgtctgggatggggtcagaaatgcatcctccagctgacagaaaaatccaggatgagatcagaaggatactggtgttttctgacttttacaaaattacttgtttgttttcattaaaaaaaaagcataaactatgtttcttattactattagaattattaaatttcaaaatgaatcca

SEQ ID NO: 358875 - DNA, 1926 bp, Homo sapiens
gtgacttaaataggaatcatagcccttcagagcccgggctcatacaaaaccacacagtgagtaggaacccagagaaaaacagacttctagttcttgatgttagccattaatgagatttggctgtgatttataatgggggtccgcagggatgggcggccttggggaagaaataaagaactagttggaagagaaggaaagaataagagtaggaattaaaaggaaattgaaaaggggtgggtagaatactgaaagcctagatactgtgaaagtttaaggattcagattttctaatgtgggtcaccagagggaaggatgtaaggagagtccacagatgcctcagtagcccttactgagactgcagaatgcctccgctactctccagcagccagaactttgagcggaaggaaggtgtgaagggggagatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagagcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaagaaaaaaaaaaaagaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaatcttgtttgtaaatatattgtctttctcttaatatttgctctgggtcaggaagaagctgttcacggtgtgataatactctttagattgtgctttcattattatagatgcatcatgtcttctgctttcacgtgtctgggatggggtcagaaatgcatcctccagctgacagaaaaatccaggatgagatcagaaggatactggtgttttctgacttttacaaaattacttgtttgttttcattaaaaaaaaagcataaactatgtttcttattactattagaattattaaatttcaaaatgaatcca

SEQ ID NO: 358876 - DNA, 1492 bp, Homo sapiens
  misc_feature (29)..(29): n is a, c, g, or t
ctttaaatatataggctaggtacgaggcngggtggtgcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagagcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaagaaaaaaaaaaaagaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaatcttgtttgtaaatatattgtctttctcttaatatttgctctgggtcaggaagaagctgttcacggtgtgataatactctttagattgtgctttcattattatagatgcatcatgtcttctgctttcacgtgtctgggatggggtcagaaatgcatcctccagctgacagaaaaatccaggatgagatcagaaggatactggtgttttctgacttttacaaaattacttgtttgttttcattaaaaaaaaagcataaactatgtttcttattactattagaattattaaatttcaaaatgaatcca

SEQ ID NO: 358877 - DNA, 899 bp, Homo sapiens
gcgccggaagcagcctgggccgctgcgcagaggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcgccatacggattacaggcgtgagccatcaagtctggcgagagagattgtttctagatgagggtgggggcgggtgtccttagcccaaagcttgtgccagtctctatcagaaataaatgcccccaaaacctca

SEQ ID NO: 358878 - DNA, 1087 bp, Homo sapiens
gttcactgggttaggcgctggggctcctgtgcgggaaggaaacaggcagttgtctttgcctgcatggagtaaagtctagcagtgggttccagcatggcaaaccacctttcctgttcttttccttctcagggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaagaaaaaaaaaaaagaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaatcttgtttgtaaatatattgtctttctcttaatatttgctctgggtcaggaagaagctgttcacggtgtgataatactctttagattgtgctttcattattatagatgcatcatgtcttctgctttcacgtgtctgggatggggtcagaaatgcatcctccagctgacagaaaaatccaggatgagatcagaaggatactggtgttttctgacttttacaaaattacttgtttgttttcattaaaaaaaaagcataaactatgtttcttattactattagaattattaaatttcaaaatgaatcca

SEQ ID NO: 358879 - DNA, 736 bp, Homo sapiens
taaggcatcttctgtgagttattaaatacccactgtgtttgtagttgtgctacagtctgttgaaggacacggaaatgtaatataaaatacttcttccgtctagagaatttggagtttcagttacataagacagtagcaaaaagtataaggtgcacagtcgtgacaatgtttgataagtgaatgctcagttatgtgtaacgtttccaggacaagggtcacagagggctgtgtaagtagaagaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaatcttgtttgtaaatatattgtctttctcttaatatttgctctgggtcaggaagaagctgttcacggtgtgataatactctttagattgtgctttcattattatagatgcatcatgtcttctgctttcacgtgtctgggatggggtcagaaatgcatcctccagctgacagaaaaatccaggatgagatcagaaggatactggtgttttctgacttttacaaaattacttgtttgttttcattaaaaaaaaagcataaactatgtttcttattactattagaattattaaatttcaaaatgaatcca

SEQ ID NO: 358880 - DNA, 564 bp, Homo sapiens
gcgccggaagcagcctgggccgctgcgcagaggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagccccaaaaggggtaccgagctc

SEQ ID NO: 358881 - DNA, 898 bp, Homo sapiens
  misc_feature (29)..(29): n is a, c, g, or t
ctttaaatatataggctaggtacgaggcngggtggtgcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcgccatacggattacaggcgtgagccatcaagtctggcgagagagattgtttctagatgagggtgggggcgggtgtccttagcccaaagcttgtgccagtctctatcagaaataaatgcccccaaaacctca

SEQ ID NO: 358882 - DNA, 1968 bp, Homo sapiens
gcgccggaagcagcctgggccgctgcgcagaggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagagcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaagaaaaaaaaaaaagaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaatcttgtttgtaaatatattgtctttctcttaatatttgctctgggtcaggaagaagctgttcacggtgtgataatactctttagattgtgctttcattattatagatgcatcatgtcttctgctttcacgtgtctgggatggggtcagaaatgcatcctccagctgacagaaaaatccaggatgagatcagaaggatactggtgttttctgacttttacaaaattacttgtttgttttcattaaaaaaaaagcataaactatgtttcttattactattagaattattaaatttcaaaatgaatccaaaaaaattgtttgtattatgtttcttataccagcatcaggtaatgtttttaaagcccatggtttgggtagcctaaatgtaaaactgaattactgagatggattttctcatttatttcaaacagtgagctatgattggaccactgcagcatagacatgctgcaacctg

SEQ ID NO: 358883 - DNA, 1394 bp, Homo sapiens
gcgccggaagcagcctgggccgctgcgcagaggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagagcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaagaaaaaaaaaatttctacttgaggggggggcccggtaccccaatttgccctattagggaggcgtatttacaattaccttggccggcgtttttccaaccgtcgg

SEQ ID NO: 358884 - DNA, 1675 bp, Homo sapiens
acgcacgtcagggctcagagcccgaggaaagaaaagtcagcgcccgagacgcgagacgccacgcggatgctttcaacgctagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagagcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaagaaaaaaaaaaaagaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaatcttgtttgtaaatatattgtctttctcttaatatttgctctgggtcaggaagaagctgttcacggtgtgataatactctttagattgtgctttcattattatagatgcatcatgtcttctgctttcacgtgtctgggatggggtcagaaatgcatcctccagctgacagaaaaatccaggatgagatcagaaggatactggtgttttctgacttttacaaaattacttgtttgttttcattaaaaaaaaagcataaactatgtttcttattactattagaattattaaatttcaaaatgaatcca

SEQ ID NO: 358885 - DNA, 1269 bp, Homo sapiens
  misc_feature (1195)..(1195): n is a, c, g, or t
gcgccggaagcagcctgggccgctgcgcagaggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagagcccaaggcccggcccttgagagtaggtgacacggagaagccagagcctgagcggtcccctcctaagcccgcaagcgtcctagctaagcgagaacggcaagcttgatgaccgtagtcaatgtagtgaagaaaagtttcatagacacaactgaaagtagggacgagtacctgaagatttgctgccacgacggtggggaatgtaaaagtattcgccctgtgcgcgtgctcgcgcgtatagtgccccctgctccagtgagagaaattggcttcctggccgggcgtggtggctcctgcctgtaatcccagcactttgcggaggccagagtgttgtgtgctggatacaacacatagaagagatacagagagaagatatatagaaagacacaaggacacatagaagcacanaaacacattggcgatgacacacgcgcacagtgatgcaatgcttgcaatattagcatgagacagagagcaaggtc

SEQ ID NO: 358886 - DNA, 905 bp, Homo sapiens
  misc_feature (881)..(881): n is a, c, g, or t
  misc_feature (899)..(899): n is a, c, g, or t
gcgccggaagcagcctgggccgctgcgcagaggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagagcccaaggcccggcccttgagagtcccctcctaaccgcagcgtcctgctaacgagaagcactgtgatatctttgagagttcagtgatagcngtatgatttgcgatgggngtttcg

SEQ ID NO: 358887 - DNA, 1112 bp, Homo sapiens
ggaaatataaagtaagaaggataaagctatagaaaccaagctgaatgagctaataaaagataatgatgatctgatgaaaggatctcaataagcatgcagatgcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaagaaaaaaaaaaaagaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaatcttgtttgtaaatatattgtctttctcttaatatttgctctgggtcaggaagaagctgttcacggtgtgataatactctttagattgtgctttcattattatagatgcatcatgtcttctgctttcacgtgtctgggatggggtcagaaatgcatcctccagctgacagaaaaatccaggatgagatcagaaggatactggtgttttctgacttttacaaaattacttgtttgttttcattaaaaaaaaagcataaactatgtttcttattactattagaattattaaatttcaaaatgaatcca

SEQ ID NO: 358888 - DNA, 2253 bp, Homo sapiens
  misc_feature (1371)..(1371): n is a, c, g, or t
cgccccttccgggtccggaacggctccagctgtacggactcgtcccgaggggagccggggacggcggcaccgggcgggtagggacaagactaccgcgcgtgcccccgcctggtggcagcccctctctgcgtccctcgcggcctggcaaaattacattcggccgagagttcacgctggggaagctctctgaatgcctctgagaagcgagatccggcgccatctcaccgacgagcctcccctttaccgccccgtgcgtttcctcagcactttaggaactaaagcctgtctgggtagctccctaacaggctctggagctcaatccctgggcagggaaaagggggtcctcggggctccccgctcgctgtcctttttctggacaggcagttccttggccacctggtagggccgcgttgcctggcaacggcagggtccttcttggctcggcggcgctcggggcctgaggggagaaaaccgccgcggagggcgctgggggtggcggcggcggtccgggaggtggtcgcgcgactgcgtggagcgccagggcgtccgacctctgcacctgagagaagatgaacacggccgaccaggcccgggtggggcccgcggacgacgggcctgcgccgtctggggaggaggagggagaggggggcggcgaggcgggcgggaaggagccagcagcggacgcggccccggggcccagcgctgcattccgcctcatggtgactcggcgggagccggccgtgaagctgcagtatgcggtgagcggcctggaaccgctggcttggtccgaggaccaccgcgtgtctgtgtccacggcccgcagcatcgctgtgctggagctcatctgcgacgtgcacaacccgggccaggacctggttatccaccgcacctcggtgcccgcaccgctcaacagctgtctcctcaaagttggctcaaaaacagaagttgctgagtgcaaggagaaattcgccgcctccaaggaccccacggtcagtcagactttcatgttggatagggtgttcaaccctgaggggaaggctttaccaccaatgagaggattcaagtacaccagctggtctcccatgggttgcgatgctaatggcaggtgcctcttggcagcactgaccatggacaatcgcctgaccatccaggcaaatctcaacagactgcagtgggtccagctggttgacctgactgagatctatggagaacgtctttatgagaccagttacaggctctctaaaaatgaggccccggaaggaaatctcggggattttgctgagtttcagaggagacacagcatgcagaccccagtcagaatggagtggtcgggcatctgtaccacccagcaggtcaagcataacaacgaangccgggacgttggcagtgtgctcctggctgtcctctttgaaaacggtaatatcgccgtgtggcagtttcagctgccgtttgtaggaaaagaatccatctcttcatgcaacacaattgagtcaggaatcacctctcccagtgtattgttttggtgggaatatgagcacaataatcgaaaaatgagtggccttattgtggggagtgcttttggacccataaaaattcttcctgtcaatctcaaagcagtcaaaggctatttcactttaaggcagcctgttatcttgtggaaagaaatggaccagttacctgtgcacagtatcaaatgtgtgccactttatcatccttaccagaagtgtagttgcagcttagtagtggctgcaagaggctcttatgtattttggtgtcttcttctgatctccaaagcagggctgaatgttcacaattcccatgtcacaggccttcactcactgccaattgtctccatgactgcagacaaacagaatggaacagtctatacttgctccagtgacggaaaggtgaggcagctgattcccattttcacagatgttgcattgaagtttgaacaccagttgattaaactctcagatgtgtttggctcagtgaggactcacgggatagcagtgagcccctgcggtgcatacctggccatcatcaccactgagggcatgatcaacggcctccaccctgttaacaaaaactaccaggtccaatttgttactctcaaaacctttgaagaagcagctgctcagctcctggaatcttcagttcaaaacctttttaagcaggtagatttaatagacctagtacgctggaagattttaaaagataaacatatccctcaatttttacaagaagctttgg

SEQ ID NO: 358889 - DNA, 5587 bp, Homo sapiens
  misc_feature (1371)..(1371): n is a, c, g, or t
cgccccttccgggtccggaacggctccagctgtacggactcgtcccgaggggagccggggacggcggcaccgggcgggtagggacaagactaccgcgcgtgcccccgcctggtggcagcccctctctgcgtccctcgcggcctggcaaaattacattcggccgagagttcacgctggggaagctctctgaatgcctctgagaagcgagatccggcgccatctcaccgacgagcctcccctttaccgccccgtgcgtttcctcagcactttaggaactaaagcctgtctgggtagctccctaacaggctctggagctcaatccctgggcagggaaaagggggtcctcggggctccccgctcgctgtcctttttctggacaggcagttccttggccacctggtagggccgcgttgcctggcaacggcagggtccttcttggctcggcggcgctcggggcctgaggggagaaaaccgccgcggagggcgctgggggtggcggcggcggtccgggaggtggtcgcgcgactgcgtggagcgccagggcgtccgacctctgcacctgagagaagatgaacacggccgaccaggcccgggtggggcccgcggacgacgggcctgcgccgtctggggaggaggagggagaggggggcggcgaggcgggcgggaaggagccagcagcggacgcggccccggggcccagcgctgcattccgcctcatggtgactcggcgggagccggccgtgaagctgcagtatgcggtgagcggcctggaaccgctggcttggtccgaggaccaccgcgtgtctgtgtccacggcccgcagcatcgctgtgctggagctcatctgcgacgtgcacaacccgggccaggacctggttatccaccgcacctcggtgcccgcaccgctcaacagctgtctcctcaaagttggctcaaaaacagaagttgctgagtgcaaggagaaattcgccgcctccaaggaccccacggtcagtcagactttcatgttggatagggtgttcaaccctgaggggaaggctttaccaccaatgagaggattcaagtacaccagctggtctcccatgggttgcgatgctaatggcaggtgcctcttggcagcactgaccatggacaatcgcctgaccatccaggcaaatctcaacagactgcagtgggtccagctggttgacctgactgagatctatggagaacgtctttatgagaccagttacaggctctctaaaaatgaggccccggaaggaaatctcggggattttgctgagtttcagaggagacacagcatgcagaccccagtcagaatggagtggtcgggcatctgtaccacccagcaggtcaagcataacaacgaangccgggacgttggcagtgtgctcctggctgtcctctttgaaaacggtaatatcgccgtgtggcagtttcagctgccgtttgtaggaaaagaatccatctcttcatgcaacacaattgagtcaggaatcacctctcccagtgtattgttttggtgggaatatgagcacaataatcgaaaaatgagtggccttattgtggggagtgcttttggacccataaaaattcttcctgtcaatctcaaagcagtcaaaggctatttcactttaaggcagcctgttatcttgtggaaagaaatggaccagttacctgtgcacagtatcaaatgtgtgccactttatcatccttaccagaagtgtagttgcagcttagtagtggctgcaagaggctcttatgtattttggtgtcttcttctgatctccaaagcagggctgaatgttcacaattcccatgtcacaggccttcactcactgccaattgtctccatgactgcagacaaacagaatggaacagtctatacttgctccagtgacggaaaggtgaggcagctgattcccattttcacagatgttgcattgaagtttgaacaccagttgattaaactctcagatgtgtttggctcagtgaggactcacgggatagcagtgagcccctgcggtgcatacctggccatcatcaccactgagggcatgatcaacggcctccaccctgttaacaaaaactaccaggtccaatttgttactctcaaaacctttgaagaagcagctgctcagctcctggaatcttcagttcaaaacctttttaagcaggtagatttaatagacctagtacgctggaagattttaaaagataaacatatccctcaatttttacaagaagctttggaaaaaaagattgaaagcagtggagtcacctatttttggcgttttaagcttttcctcctgaggattttatatcagtcaatgcagaaaaccccttcagaagccttgtggaaacccacccatgaggactcaaaaatcttactagtggattcgcctgggatgggcaatgctgacgatgaacagcaggaagaaggcacttcttccaaacaggtggtgaagcaaggcctgcaggagaggagcaaggaaggagatgtagaggagcccactgatgactcgctccccacgactggagatgctggaggccgtgagccaatggaagagaaactcctggaaatccaagggaaaatcgaagctgtggagatgcacttgaccagggaacacatgaagcgagtcttaggagaagtgtatctgcacacctggatcacagaaaacactagcatccccacccgcggactctgtaactttttaatgtctgatgaagagtatgatgacagaactgcacgggtgctgattggacatatctcaaagaagatgaacaaacagactttccctgagcactgtagtttgtgtaaagagatcttgccattcacagatcgcaaacaggcagtctgttccaatggccacatttggctccggtgcttcttaacctaccagtcctgccagagtttgatatatagaaggtgtttgctccatgacagcattgcccggcatccagctccagaagatcccgactggattaagaggttactgcaaagcccctgccctttctgtgattctcctgtcttctaaataatcagtgacgggaagatggaagggcatgatgaactctgccatagaaaacttcctccagcctgaagagaaggatgcactggaggaagccggaccctcacgagtggagagaagtccttggtgattgtaaagagggcccctggagctcatttctgaatcgcactctccatttccagagactaaaggatgtcctttgaaatggctggactcagagagttggagtcgttttgagatgagcattagccccagctttgtaaccaatgaggaacacttacttatttttaagtatcttgacagaagcaatttgaacacagtgtcccgtcatttctagaaacagaatggtctcttctagagagcttggataaggaccttgctgggttgagttaggttttaatccttgctttggtttggaactgccttcgggctccagaacttaaattgcttggtccgtggcatctgatgtaccaacagagattaaaagtgtaaagcaacacatgggctgatgttttgttctcagaaaatagctgctggtctgcatccctccattcttgttttttatgcatatggaaaacattttcctaaaactctatattcttaagttgaagccaagactaaaatttaatgtgtcaaatgatctggtgactattataatgaataattgtgacttatttttcattctctcctgggtcatcaggtttcctgacccaactccttaatccgtataaagatgtcaaatactgtagttcacccacgccacagccctgcttcagacttaactgtggtagcctagatgagctatttgtacacagaggaaaaaaagatattttcctcttttagtaataagactttcagtatttttaatgttgacatttccagatgtttcatttagtatccaggggtctgtctggagacttctagagagggacagctcagaagtgagacccttgagctctggtgctgtaagcttgtgcaattaagttgaacagagcctgggaatttctttcctctgcacagtcccttgatatttggaatccaggttctgcccccaacccctacccacccagtggtctgttaagatgtctcagatggggctgggcttggtggctcatgcctgtactctcaacactttgggaagcaaaggcaggcagatcacaaggtcaggagttcagcctaaccaacatggtgaaaccgtgtctctactaaaaatacaaaaattagccaggcgtggtggtgcacacctgtaatcccagcactttgggaggccgaggcagacgggtcacttgaggccaggagttcgagaccagcctgggcaatatggcgagactccgtctctactacaaatacaaaagttagcctggcatggtggcgcatgcctgtaatctcagttactcaggaggctgaggcaggagcatcacttcaacccaggaggcagaagctgcagtcagccgaggtggcaccactgcacttcagcctgggcaagactggagactgcctcaaaaaaaaaagaaaaaaaatgttggtacttagatgataccatgacggcaacctccccacccccaccccgcattgataggtagtgcagaccagcccttggaggcacttctaaacagtctgctcagaaatgttttctgtttcctattcaaattgctgttttgtctcctatgtttaatcatgtatttgctattctgcttatttttctcatttggtggtaatttcaagaagagcgtttatccactattgattttcaagaaagaaaccaagcagcattgaaatcatgagtaacagaattcagaacattgtatggtggaagtcatttgtgtctgcagctgttttttcactttacaataaataagagtaaaaattgagatcatgtcaaaaaattattgcagttttaatcattatggcatagtttcacttcccctccccccattagaatcagtggagatttgttcttactagggaattttggactgctgccatttaaaacttaggtttttatttaaagcagttgtgcatttttgagaaaatgtattgggagtaactagagaggatctcccaaatttttttgtatgtctctctaggagtaaacatggcaacagtttttctagaacgtggactcactgcagggactggacccaatggcattgttaagaccctaaaatctagccaccacctgcctcccccaggtttccacacacccagttggaaggcctttccctgcccttgtccctgtctcacacccatggaggttaagctacagagctggggaaacaggagattttgagttaatggcagcctcacaaatagtgcttctgaatttctctgagggtcagcatacctcatgggagtgtgttgctcagtgcaaccttggaaaagtgggaatggcaccagacgtttttcaggtgcctcttgcaattcaaacttacatcctctataccgtcctaaaatttgcctgatcttatttggtagatttcaagttgctttcagctgtgaccgtaataactgtttcaggaactggagaaatagtggaagcgctatgtccgcgctgc

SEQ ID NO: 358890 - DNA, 5169 bp, Homo sapiens
  misc_feature (953)..(953): n is a, c, g, or t
aacaatcggagctatgggcatcgaggtcccgtgcggggtattaaaattgggcacggaagggtgtggcgctgggggtggcggcggcggtccgggaggtggtcgcgcgactgcgtggagcgccagggcgtccgacctctgcacctgagagaagatgaacacggccgaccaggcccgggtggggcccgcggacgacgggcctgcgccgtctggggaggaggagggagaggggggcggcgaggcgggcgggaaggagccagcagcggacgcggccccggggcccagcgctgcattccgcctcatggtgactcggcgggagccggccgtgaagctgcagtatgcggtgagcggcctggaaccgctggcttggtccgaggaccaccgcgtgtctgtgtccacggcccgcagcatcgctgtgctggagctcatctgcgacgtgcacaacccgggccaggacctggttatccaccgcacctcggtgcccgcaccgctcaacagctgtctcctcaaagttggctcaaaaacagaagttgctgagtgcaaggagaaattcgccgcctccaaggaccccacggtcagtcagactttcatgttggatagggtgttcaaccctgaggggaaggctttaccaccaatgagaggattcaagtacaccagctggtctcccatgggttgcgatgctaatggcaggtgcctcttggcagcactgaccatggacaatcgcctgaccatccaggcaaatctcaacagactgcagtgggtccagctggttgacctgactgagatctatggagaacgtctttatgagaccagttacaggctctctaaaaatgaggccccggaaggaaatctcggggattttgctgagtttcagaggagacacagcatgcagaccccagtcagaatggagtggtcgggcatctgtaccacccagcaggtcaagcataacaacgaangccgggacgttggcagtgtgctcctggctgtcctctttgaaaacggtaatatcgccgtgtggcagtttcagctgccgtttgtaggaaaagaatccatctcttcatgcaacacaattgagtcaggaatcacctctcccagtgtattgttttggtgggaatatgagcacaataatcgaaaaatgagtggccttattgtggggagtgcttttggacccataaaaattcttcctgtcaatctcaaagcagtcaaaggctatttcactttaaggcagcctgttatcttgtggaaagaaatggaccagttacctgtgcacagtatcaaatgtgtgccactttatcatccttaccagaagtgtagttgcagcttagtagtggctgcaagaggctcttatgtattttggtgtcttcttctgatctccaaagcagggctgaatgttcacaattcccatgtcacaggccttcactcactgccaattgtctccatgactgcagacaaacagaatggaacagtctatacttgctccagtgacggaaaggtgaggcagctgattcccattttcacagatgttgcattgaagtttgaacaccagttgattaaactctcagatgtgtttggctcagtgaggactcacgggatagcagtgagcccctgcggtgcatacctggccatcatcaccactgagggcatgatcaacggcctccaccctgttaacaaaaactaccaggtccaatttgttactctcaaaacctttgaagaagcagctgctcagctcctggaatcttcagttcaaaacctttttaagcaggtagatttaatagacctagtacgctggaagattttaaaagataaacatatccctcaatttttacaagaagctttggaaaaaaagattgaaagcagtggagtcacctatttttggcgttttaagcttttcctcctgaggattttatatcagtcaatgcagaaaaccccttcagaagccttgtggaaacccacccatgaggactcaaaaatcttactagtggattcgcctgggatgggcaatgctgacgatgaacagcaggaagaaggcacttcttccaaacaggtggtgaagcaaggcctgcaggagaggagcaaggaaggagatgtagaggagcccactgatgactcgctccccacgactggagatgctggaggccgtgagccaatggaagagaaactcctggaaatccaagggaaaatcgaagctgtggagatgcacttgaccagggaacacatgaagcgagtcttaggagaagtgtatctgcacacctggatcacagaaaacactagcatccccacccgcggactctgtaactttttaatgtctgatgaagagtatgatgacagaactgcacgggtgctgattggacatatctcaaagaagatgaacaaacagactttccctgagcactgtagtttgtgtaaagagatcttgccattcacagatcgcaaacaggcagtctgttccaatggccacatttggctccggtgcttcttaacctaccagtcctgccagagtttgatatatagaaggtgtttgctccatgacagcattgcccggcatccagctccagaagatcccgactggattaagaggttactgcaaagcccctgccctttctgtgattctcctgtcttctaaataatcagtgacgggaagatggaagggcatgatgaactctgccatagaaaacttcctccagcctgaagagaaggatgcactggaggaagccggaccctcacgagtggagagaagtccttggtgattgtaaagagggcccctggagctcatttctgaatcgcactctccatttccagagactaaaggatgtcctttgaaatggctggactcagagagttggagtcgttttgagatgagcattagccccagctttgtaaccaatgaggaacacttacttatttttaagtatcttgacagaagcaatttgaacacagtgtcccgtcatttctagaaacagaatggtctcttctagagagcttggataaggaccttgctgggttgagttaggttttaatccttgctttggtttggaactgccttcgggctccagaacttaaattgcttggtccgtggcatctgatgtaccaacagagattaaaagtgtaaagcaacacatgggctgatgttttgttctcagaaaatagctgctggtctgcatccctccattcttgttttttatgcatatggaaaacattttcctaaaactctatattcttaagttgaagccaagactaaaatttaatgtgtcaaatgatctggtgactattataatgaataattgtgacttatttttcattctctcctgggtcatcaggtttcctgacccaactccttaatccgtataaagatgtcaaatactgtagttcacccacgccacagccctgcttcagacttaactgtggtagcctagatgagctatttgtacacagaggaaaaaaagatattttcctcttttagtaataagactttcagtatttttaatgttgacatttccagatgtttcatttagtatccaggggtctgtctggagacttctagagagggacagctcagaagtgagacccttgagctctggtgctgtaagcttgtgcaattaagttgaacagagcctgggaatttctttcctctgcacagtcccttgatatttggaatccaggttctgcccccaacccctacccacccagtggtctgttaagatgtctcagatggggctgggcttggtggctcatgcctgtactctcaacactttgggaagcaaaggcaggcagatcacaaggtcaggagttcagcctaaccaacatggtgaaaccgtgtctctactaaaaatacaaaaattagccaggcgtggtggtgcacacctgtaatcccagcactttgggaggccgaggcagacgggtcacttgaggccaggagttcgagaccagcctgggcaatatggcgagactccgtctctactacaaatacaaaagttagcctggcatggtggcgcatgcctgtaatctcagttactcaggaggctgaggcaggagcatcacttcaacccaggaggcagaagctgcagtcagccgaggtggcaccactgcacttcagcctgggcaagactggagactgcctcaaaaaaaaaagaaaaaaaatgttggtacttagatgataccatgacggcaacctccccacccccaccccgcattgataggtagtgcagaccagcccttggaggcacttctaaacagtctgctcagaaatgttttctgtttcctattcaaattgctgttttgtctcctatgtttaatcatgtatttgctattctgcttatttttctcatttggtggtaatttcaagaagagcgtttatccactattgattttcaagaaagaaaccaagcagcattgaaatcatgagtaacagaattcagaacattgtatggtggaagtcatttgtgtctgcagctgttttttcactttacaataaataagagtaaaaattgagatcatgtcaaaaaattattgcagttttaatcattatggcatagtttcacttcccctccccccattagaatcagtggagatttgttcttactagggaattttggactgctgccatttaaaacttaggtttttatttaaagcagttgtgcatttttgagaaaatgtattgggagtaactagagaggatctcccaaatttttttgtatgtctctctaggagtaaacatggcaacagtttttctagaacgtggactcactgcagggactggacccaatggcattgttaagaccctaaaatctagccaccacctgcctcccccaggtttccacacacccagttggaaggcctttccctgcccttgtccctgtctcacacccatggaggttaagctacagagctggggaaacaggagattttgagttaatggcagcctcacaaatagtgcttctgaatttctctgagggtcagcatacctcatgggagtgtgttgctcagtgcaaccttggaaaagtgggaatggcaccagacgtttttcaggtgcctcttgcaattcaaacttacatcctctataccgtcctaaaatttgcctgatcttatttggtagatttcaagttgctttcagctgtgaccgtaataactgtttcaggaactggagaaatagtggaagcgctatgtccgcgctgc

SEQ ID NO: 358891 - DNA, 2246 bp, Homo sapiens
cgccccttccgggtccggaacggctccagctgtacggactcgtcccgaggggagccggggacggcggcaccgggcgggtagggacaagactaccgcgcgtgcccccgcctggtggcagcccctctctgcgtccctcgcggcctggcaaaattacattcggccgagagttcacgctggggaagctctctgaatgcctctgagaagcgagatccggcgccatctcaccgacgagcctcccctttaccgccccgtgcgtttcctcagcactttaggaactaaagcctgtctgggtagctccctaacaggctctggagctcaatccctgggcagggaaaagggggtcctcggggctccccgctcgctgtcctttttctggacaggcagttccttggccacctggtagggccgcgttgcctggcaacggcagggtccttcttggctcggcggcgctcggggcctgaggggagaaaaccgccgcggagggcgctgggggtggcggcggcggtccgggaggtggtcgcgcgactgcgtggagcgccagggcgtccgacctctgcacctgagagaagatgaacacggccgaccaggcccgggtggggcccgcggacgacgggcctgcgccgtctggggaggaggagggagaggggggcggcgaggcgggcgggaaggagccagcagcggacgcggccccggggcccagcgctgcattccgcctcatggtgactcggcgggagccggccgtgaagctgcagtatgcggtgagcggcctggaaccgctggcttggtccgaggaccaccgcgtgtctgtgtccacggcccgcagcatcgctgtgctggagctcatctgcgacgtgcacaacccgggccaggacctggttatccaccgcacctcggtgcccgcaccgctcaacagctgtctcctcaaagttggctcaaaaacagaagttgctgagtgcaaggagaaattcgccgcctccaaggaccccacggtcagtcagactttcatgttggatagggtgttcaaccctgaggggaaggctttaccaccaatgagaggattcaagtacaccagctggtctcccatgggttgcgatgctaatggcaggtgcctcttggcagcactgaccatggacaatcgcctgaccatccaggcaaatctcacttcagcctgggcaagactggagactgcctcaaaaaaaaaagaaaaaaaatgttggtacttagatgataccatgacggcaacctccccacccccaccccgcattgataggtagtgcagaccagcccttggaggcacttctaaacagtctgctcagaaatgttttctgtttcctattcaaattgctgttttgtctcctatgtttaatcatgtatttgctattctgcttatttttctcatttggtggtaatttcaagaagagcgtttatccactattgattttcaagaaagaaaccaagcagcattgaaatcatgagtaacagaattcagaacattgtatggtggaagtcatttgtgtctgcagctgttttttcactttacaataaataagagtaaaaattgagatcatgtcaaaaaattattgcagttttaatcattatggcatagtttcacttcccctccccccattagaatcagtggagatttgttcttactagggaattttggactgctgccatttaaaacttaggtttttatttaaagcagttgtgcatttttgagaaaatgtattgggagtaactagagaggatctcccaaatttttttgtatgtctctctaggagtaaacatggcaacagtttttctagaacgtggactcactgcagggactggacccaatggcattgttaagaccctaaaatctagccaccacctgcctcccccaggtttccacacacccagttggaaggcctttccctgcccttgtccctgtctcacacccatggaggttaagctacagagctggggaaacaggagattttgagttaatggcagcctcacaaatagtgcttctgaatttctctgagggtcagcatacctcatgggagtgtgttgctcagtgcaaccttggaaaagtgggaatggcaccagacgtttttcaggtgcctcttgcaattcaaacttacatcctctataccgtcctaaaatttgcctgatcttatttggtagatttcaagttgctttcagctgtgaccgtaataactgtttcaggaactggagaaatagtggaagcgctatgtccgcgctgc

SEQ ID NO: 358892 - DNA, 479 bp, Homo sapiens
  misc_feature (1)..(1): n is a, c, g, or t
ntctatacaattcagctcggtacccccagtacaacagctccagttacaacagctctagtggattcgcctgggatgggcaatgctgacgatgaacagcaggaagaaggcacttcttccaaacaggtggtgaagcaaggcctgcaggagaggagcaaggaaggagatgtagaggagcccactgatgactcgctccccacgactggagatgctggaggccgtgagccaatggaagagaaactcctggaaatccaagggaaaatcgaagctgtggagatgcacttgaccagggaacacatgaagcgagtcttaggagaagtgtatctgcacacctggatcacagaaaacactagcatccccacccgcggactctgtaactttttaatgtctgatgaagagtatgatgacagaactgcacgggtaggtgtttattaacaaaaactctgaaattgtaaagcctgctttcttcatgagaaagaaat

SEQ ID NO: 358893 - DNA, 3561 bp, Homo sapiens
  misc_feature (1371)..(1371): n is a, c, g, or t
cgccccttccgggtccggaacggctccagctgtacggactcgtcccgaggggagccggggacggcggcaccgggcgggtagggacaagactaccgcgcgtgcccccgcctggtggcagcccctctctgcgtccctcgcggcctggcaaaattacattcggccgagagttcacgctggggaagctctctgaatgcctctgagaagcgagatccggcgccatctcaccgacgagcctcccctttaccgccccgtgcgtttcctcagcactttaggaactaaagcctgtctgggtagctccctaacaggctctggagctcaatccctgggcagggaaaagggggtcctcggggctccccgctcgctgtcctttttctggacaggcagttccttggccacctggtagggccgcgttgcctggcaacggcagggtccttcttggctcggcggcgctcggggcctgaggggagaaaaccgccgcggagggcgctgggggtggcggcggcggtccgggaggtggtcgcgcgactgcgtggagcgccagggcgtccgacctctgcacctgagagaagatgaacacggccgaccaggcccgggtggggcccgcggacgacgggcctgcgccgtctggggaggaggagggagaggggggcggcgaggcgggcgggaaggagccagcagcggacgcggccccggggcccagcgctgcattccgcctcatggtgactcggcgggagccggccgtgaagctgcagtatgcggtgagcggcctggaaccgctggcttggtccgaggaccaccgcgtgtctgtgtccacggcccgcagcatcgctgtgctggagctcatctgcgacgtgcacaacccgggccaggacctggttatccaccgcacctcggtgcccgcaccgctcaacagctgtctcctcaaagttggctcaaaaacagaagttgctgagtgcaaggagaaattcgccgcctccaaggaccccacggtcagtcagactttcatgttggatagggtgttcaaccctgaggggaaggctttaccaccaatgagaggattcaagtacaccagctggtctcccatgggttgcgatgctaatggcaggtgcctcttggcagcactgaccatggacaatcgcctgaccatccaggcaaatctcaacagactgcagtgggtccagctggttgacctgactgagatctatggagaacgtctttatgagaccagttacaggctctctaaaaatgaggccccggaaggaaatctcggggattttgctgagtttcagaggagacacagcatgcagaccccagtcagaatggagtggtcgggcatctgtaccacccagcaggtcaagcataacaacgaangccgggacgttggcagtgtgctcctggctgtcctctttgaaaacggtaatatcgccgtgtggcagtttcagctgccgtttgtaggaaaagaatccatctcttcatgcaacacaattgagtcaggaatcacctctcccagtgtattgttttggtgggaatatgagcacaataatcgaaaaatgagtggccttattgtggggagtgcttttggacccataaaaattcttcctgtcaatctcaaagcagtcaaaggctatttcactttaaggcagcctgttatcttgtggaaagaaatggaccagttacctgtgcacagtatcaaatgtgtgccactttatcatccttaccagaagtgtagttgcagcttagtagtggctgcaagaggctcttatgtattttggtgtcttcttctgatctccaaagcagggctgaatgttcacaattcccatgtcacaggccttcactcactgccaattgtctccatgactgcagacaaacagaatggaacagtctatacttgctccagtgacggaaaggtgaggcagctgattcccattttcacagatgttgcattgaagtttgaacaccagttgattaaactctcagatgtgtttggctcagtgaggactcacgggatagcagtgagcccctgcggtgcatacctggccatcatcaccactgagggcatgatcaacggcctccaccctgttaacaaaaactaccaggtccaatttgttactctcaaaacctttgaagaagcagctgctcagctcctggaatcttcagttcaaaacctttttaagcaggtagatttaatagacctagtacgctggaagattttaaaagataaacatatccctcaatttttacaagaagctttggaaaaaaagattgaaagcagtggagtcacctatttttggcgttttaagcttttcctcctgaggattttatatcagtcaatgcagaaaaccccttcagaagccttgtggaaacccacccatgaggactcaaaaatcttactagtggattcgcctgggatgggcaatgctgacgatgaacagcaggaagaaggcacttcttccaaacaggtggtgaagcaaggcctgcaggagaggagcaaggaaggagatgtagaggagcccactgatgactcgctccccacgactggagatgctggaggccgtgagccaatggaagagaaactcctggaaatccaagggaaaatcgaagctgtggagatgcacttgaccagggaacacatgaagcgagtcttaggagaagtgtatctgcacacctggatcacagaaaacactagcatccccacccgcggactctgtaactttttaatgtctgatgaagagtatgatgacagaactgcacgggtgctgattggacatatctcaaagaagatgaacaaacagactttccctgagcactgtagtttgtgtaaagagatcttgccattcacagatcgcaaacaggcagtctgttccaatggccacatttggctccggtgcttcttaacctaccagtcctgccagagtttgatatatagaaggtgtttgctccatgacagcattgcccggcatccagctccagaagatcccgactggattaagaggttactgcaaagcccctgccctttctgtgattctcctgtcttctaaataatcagtgacgggaagatggaagggcatgatgaactctgccatagaaaacttcctccagcctgaagagaaggatgcactggaggaagccggaccctcacgagtggagagaagtccttggtgattgtaaagagggcccctggagctcatttctgaatcgcactctccatttccagagactaaaggatgtcctttgaaatggctggactcagagagttggagtcgttttgagatgagcattagccccagctttgtaaccaatgaggaacacttacttatttttaagtatcttgacagaagcaatttgaacacagtgtcccgtcatttctagaaacagaatggtctcttctagagagcttggataaggaccttgctgggttgagttaggttttaatccttgctttggtttggaactgccttcgggctccagaacttaaattgcttggtccgtggcatctgatgtaccaacagagattaaaagtgtaaagcaaaaaaaaaaaagtcgacgcggccgcgaatttag

SEQ ID NO: 358894 - DNA, 5533 bp, Homo sapiens
  misc_feature (1371)..(1371): n is a, c, g, or t
cgccccttccgggtccggaacggctccagctgtacggactcgtcccgaggggagccggggacggcggcaccgggcgggtagggacaagactaccgcgcgtgcccccgcctggtggcagcccctctctgcgtccctcgcggcctggcaaaattacattcggccgagagttcacgctggggaagctctctgaatgcctctgagaagcgagatccggcgccatctcaccgacgagcctcccctttaccgccccgtgcgtttcctcagcactttaggaactaaagcctgtctgggtagctccctaacaggctctggagctcaatccctgggcagggaaaagggggtcctcggggctccccgctcgctgtcctttttctggacaggcagttccttggccacctggtagggccgcgttgcctggcaacggcagggtccttcttggctcggcggcgctcggggcctgaggggagaaaaccgccgcggagggcgctgggggtggcggcggcggtccgggaggtggtcgcgcgactgcgtggagcgccagggcgtccgacctctgcacctgagagaagatgaacacggccgaccaggcccgggtggggcccgcggacgacgggcctgcgccgtctggggaggaggagggagaggggggcggcgaggcgggcgggaaggagccagcagcggacgcggccccggggcccagcgctgcattccgcctcatggtgactcggcgggagccggccgtgaagctgcagtatgcggtgagcggcctggaaccgctggcttggtccgaggaccaccgcgtgtctgtgtccacggcccgcagcatcgctgtgctggagctcatctgcgacgtgcacaacccgggccaggacctggttatccaccgcacctcggtgcccgcaccgctcaacagctgtctcctcaaagttggctcaaaaacagaagttgctgagtgcaaggagaaattcgccgcctccaaggaccccacggtcagtcagactttcatgttggatagggtgttcaaccctgaggggaaggctttaccaccaatgagaggattcaagtacaccagctggtctcccatgggttgcgatgctaatggcaggtgcctcttggcagcactgaccatggacaatcgcctgaccatccaggcaaatctcaacagactgcagtgggtccagctggttgacctgactgagatctatggagaacgtctttatgagaccagttacaggctctctaaaaatgaggccccggaaggaaatctcggggattttgctgagtttcagaggagacacagcatgcagaccccagtcagaatggagtggtcgggcatctgtaccacccagcaggtcaagcataacaacgaangccgggacgttggcagtgtgctcctggctgtcctctttgaaaacggtaatatcgccgtgtggcagtttcagctgccgtttgtaggaaaagaatccatctcttcatgcaacacaattgagtcaggaatcacctctcccagtgtattgttttggtgggaatatgagcacaataatcgaaaaatgagtggccttattgtggggagtgcttttggacccataaaaattcttcctgtcaatctcaaagcagtcaaaggctatttcactttaaggcagcctgttatcttgtggaaagaaatggaccagttacctgtgcacagtatcaaatgtgtgccactttatcatccttaccagaagtgtagttgcagcttagtagtggctgcaagaggctcttatgtattttggtgtcttcttctgatctccaaagcagggctgaatgttcacaattcccatgtcacaggccttcactcactgccaattgtctccatgactgcagacaaacagaatggaacagtctatacttgctccagtgacggaaaggtgaggcagctgattcccattttcacagatgttgcattgaagtttgaacaccagttgattaaactctcagatgtgtttggctcagtgaggactcacgggatagcagtgagcccctgcggtgcatacctggccatcatcaccactgagggcatgatcaacggcctccaccctgttaacaaaaactaccaggtccaatttgttactctcaaaacctttgaagaagcagctgctcagctcctggaatcttcagttcaaaacctttttaagcaggtagatttaatagacctagtacgctggaagattttaaaagataaacatatccctcaatttttacaagaagctttggaaaaaaagattgaaagcagtggagtcacctatttttggcgttttaagcttttcctcctgaggattttatatcagtcaatgcagaaaaccccttcagaagccttgtggaaacccacccatgaggactcaaaaatcttactagtggattcgcctgggatgggcaatgctgacgatgaacagcaggaagaaggcacttcttccaaacaggtggtgaagcaaggcctgcaggagaggagcaaggaaggagatgtagaggagcccactgatgactcgctccccacgactggagatgctggaggccgtgagccaatggaagagaaactcctggaaatccaagggaaaatcgaagctgtggagatgcacttgaccagggaacacatgaagcgagtcttaggagaagtgtatctgcacacctggatcacagagtatgatgacagaactgcacgggtgctgattggacatatctcaaagaagatgaacaaacagactttccctgagcactgtagtttgtgtaaagagatcttgccattcacagatcgcaaacaggcagtctgttccaatggccacatttggctccggtgcttcttaacctaccagtcctgccagagtttgatatatagaaggtgtttgctccatgacagcattgcccggcatccagctccagaagatcccgactggattaagaggttactgcaaagcccctgccctttctgtgattctcctgtcttctaaataatcagtgacgggaagatggaagggcatgatgaactctgccatagaaaacttcctccagcctgaagagaaggatgcactggaggaagccggaccctcacgagtggagagaagtccttggtgattgtaaagagggcccctggagctcatttctgaatcgcactctccatttccagagactaaaggatgtcctttgaaatggctggactcagagagttggagtcgttttgagatgagcattagccccagctttgtaaccaatgaggaacacttacttatttttaagtatcttgacagaagcaatttgaacacagtgtcccgtcatttctagaaacagaatggtctcttctagagagcttggataaggaccttgctgggttgagttaggttttaatccttgctttggtttggaactgccttcgggctccagaacttaaattgcttggtccgtggcatctgatgtaccaacagagattaaaagtgtaaagcaacacatgggctgatgttttgttctcagaaaatagctgctggtctgcatccctccattcttgttttttatgcatatggaaaacattttcctaaaactctatattcttaagttgaagccaagactaaaatttaatgtgtcaaatgatctggtgactattataatgaataattgtgacttatttttcattctctcctgggtcatcaggtttcctgacccaactccttaatccgtataaagatgtcaaatactgtagttcacccacgccacagccctgcttcagacttaactgtggtagcctagatgagctatttgtacacagaggaaaaaaagatattttcctcttttagtaataagactttcagtatttttaatgttgacatttccagatgtttcatttagtatccaggggtctgtctggagacttctagagagggacagctcagaagtgagacccttgagctctggtgctgtaagcttgtgcaattaagttgaacagagcctgggaatttctttcctctgcacagtcccttgatatttggaatccaggttctgcccccaacccctacccacccagtggtctgttaagatgtctcagatggggctgggcttggtggctcatgcctgtactctcaacactttgggaagcaaaggcaggcagatcacaaggtcaggagttcagcctaaccaacatggtgaaaccgtgtctctactaaaaatacaaaaattagccaggcgtggtggtgcacacctgtaatcccagcactttgggaggccgaggcagacgggtcacttgaggccaggagttcgagaccagcctgggcaatatggcgagactccgtctctactacaaatacaaaagttagcctggcatggtggcgcatgcctgtaatctcagttactcaggaggctgaggcaggagcatcacttcaacccaggaggcagaagctgcagtcagccgaggtggcaccactgcacttcagcctgggcaagactggagactgcctcaaaaaaaaaagaaaaaaaatgttggtacttagatgataccatgacggcaacctccccacccccaccccgcattgataggtagtgcagaccagcccttggaggcacttctaaacagtctgctcagaaatgttttctgtttcctattcaaattgctgttttgtctcctatgtttaatcatgtatttgctattctgcttatttttctcatttggtggtaatttcaagaagagcgtttatccactattgattttcaagaaagaaaccaagcagcattgaaatcatgagtaacagaattcagaacattgtatggtggaagtcatttgtgtctgcagctgttttttcactttacaataaataagagtaaaaattgagatcatgtcaaaaaattattgcagttttaatcattatggcatagtttcacttcccctccccccattagaatcagtggagatttgttcttactagggaattttggactgctgccatttaaaacttaggtttttatttaaagcagttgtgcatttttgagaaaatgtattgggagtaactagagaggatctcccaaatttttttgtatgtctctctaggagtaaacatggcaacagtttttctagaacgtggactcactgcagggactggacccaatggcattgttaagaccctaaaatctagccaccacctgcctcccccaggtttccacacacccagttggaaggcctttccctgcccttgtccctgtctcacacccatggaggttaagctacagagctggggaaacaggagattttgagttaatggcagcctcacaaatagtgcttctgaatttctctgagggtcagcatacctcatgggagtgtgttgctcagtgcaaccttggaaaagtgggaatggcaccagacgtttttcaggtgcctcttgcaattcaaacttacatcctctataccgtcctaaaatttgcctgatcttatttggtagatttcaagttgctttcagctgtgaccgtaataactgtttcaggaactggagaaatagtggaagcgctatgtccgcgctgc

SEQ ID NO: 358895 - DNA, 983 bp, Homo sapiens
cgccccttccgggtccggaacggctccagctgtacggactcgtcccgaggggagccggggacggcggcaccgggcgggtagggacaagactaccgcgcgtgcccccgcctggtggcagcccctctctgcgtccctcgcggcctggcaaaattacattcggccgagagttcacgctggggaagctctctgaatgcctctgagaagcgagatccggcgccatctcaccgacgagcctcccctttaccgccccgtgcgtttcctcagcactttaggaactaaagcctgtctgggtagctccctaacaggctctggagctcaatccctgggcagggaaaagggggtcctcggggctccccgctcgctgtcctttttctggacaggcagttccttggccacctggtagggccgcgttgcctggcaacggcagggtccttcttggctcggcggcgctcggggcctgaggggagaaaaccgccgcggagggcgctgggggtggcggcggcggtccgggaggtggtcgcgcgactgcgtggagcgccagggcgtccgacctctgcacctgagagaagatgaacacggccgaccaggcccgggtggggcccgcggacgacgggcctgcgccgtctggggaggaggagggagaggggggcggcgaggcgggcgggaaggagccagcagcggacgcggccccggggcccagcgctgcattccgcctcatggtgactcggcgggagccggccgtgaagctgcagtatgcggtgagcggcctggaaccgctggcttggtccgaggaccaccgcgtgtctgtgtccacggcccgcagcatcgctgtgctggagctcatctgcgacgtgcacaacccgggccaggacctggttatccaccgcacctcggtgcccgcaccgctcaacagctgtctcctcaaagtaagtcatcccccgccatccctggggtcttcccctgtccccctctcgcggccgcat

SEQ ID NO: 358896 - DNA, 4319 bp, Homo sapiens
cggggagggcgggcctgtcgcagccgcgctggtcgccaggcgtccgggaggagcggggtccgcgcggcggacgaggcgggggcggaggcgcaggcagagcgagcgcgggaggtcgccgcagccagggacaccgcgcgccgccgctcaacatggtcgctgcgcacgctgcccattcttcctcctctgccgagtggatcgcctgcctggataaaagaccactggagcgatccagcgaagatgtggatataatcttcactcgactgaaagaagttaaagcttttgagaaatttcacccaaatctccttcatcagatttgcttatgtggttattatgagaatctggaaaagggaataacattatttcgccagggtgatattggaacaaactggtatgctgtcctggcagggtctttggatgttaaagtatctgagaccagcagtcaccaggatgctgtgaccatctgtaccctgggaattgggacggcctttggagagtccattctggacaacacaccccgccatgcaaccatcgttaccagggagagcagtgaactgctccgcatcgagcagaaggacttcaaggcactatgggagaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtatctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatagagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgaccgggaaaaaaaaaa

SEQ ID NO: 358897 - DNA, 3282 bp, Homo sapiens
cggggagggcgggcctgtcgcagccgcgctggtcgccaggcgtccgggaggagcggggtccgcgcggcggacgaggcgggggcggaggcgcaggcagagcgagcgcgggaggtcgccgcagccagggacaccgcgcgccgccgctcaacatggtcgctgcgcacgctgcccattcttcctcctctgccgagtggatcgcctgcctggataaaagaccactggagcgatccagcgaagatgtggatataatcttcactcgactgaaagaagttaaagcttttgagaaatttcacccaaatctccttcatcagatttgcttatgtggttattatgagaatctggaaaagggaataacattatttcgccagggtgatattggaacaaactggtatgctgtcctggcagggtctttggatgttaaagtatctgagaccagcagtcaccaggatgctgtgaccatctgtaccctgggaattgggacggcctttggagagtccattctggacaacacaccccgccatgcaaccatcgttaccagggagagcagtgaactgctccgcatcgagcagaaggacttcaaggcactatgggagaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaacaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatagagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgaccgggaaaaaaaaaa

SEQ ID NO: 358898 - DNA, 2799 bp, Homo sapiens
gaattcccgttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgcagtaccagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcaggggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagttttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacttctggcaggtttggaaatttccaaataaatccttttgtctattggtggtgcctggacctggtcc

SEQ ID NO: 358899 - DNA, 2705 bp, Homo sapiens
ggcagtgacactgcccctgtgcctctcagccatgcttcttcttcatgatgggagaaagagaaggagggcagggcttggcaggactgtctgagagaatagggaccagcttgcccagggaatagggcacagcatgctggggctggaaggtagcaatgggccctgaaaagctccccaaggcccttccctctgcaggcaggaccctcctcccagcccaggttctggcaggcctcattcgctggcatggctgccagggcggttgcagggggcagggcaggtgtggtttacactctgtgctcaggcgcccactcccctttgttcctggggctccagcagggctctggtgtgctgctcaggccctacctggctgacgagagggatggagggcatgggctatgggtcccggagggccttgcccctgacctatgcacccccgttggctcacttccccccgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccggggaagaggaggacagatggccagataaggtctacctcaggggaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcaggggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagttttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacttctggcaggtttggaaatttccaaataaatccttttgtctattggtggtgcctggacctggtcc

SEQ ID NO: 358900 - DNA, 1831 bp, Homo sapiens
gaatgccggctctctggggaattccggctctatgggccggctctctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagttttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacttctggcaggtttggaaatttccaaataaatccttttgtctattggtggtgcctggacctggtcc

SEQ ID NO: 358901 - DNA, 2719 bp, Homo sapiens
gaattcccgttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggccgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcaggggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagttttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtagcaggcaagcagacgcccccatagattgtcagctgtaagtgaaactcctagtgaaaaagaggggagccctgtgttaggagtccccataaacatgtactgtaattctttgtatatagaaaaaaaatttactgtaaagtaaagtttaactttactcataaaaaaa

SEQ ID NO: 358902 - DNA, 1347 bp, Homo sapiens
taccggcccggtatgggatgtcccagtagactgatggtcatctacatgtcactggtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagttttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacttctggcaggtttggaaatttccaaataaatccttttgtctattggtggtgcctggacctggtcc

SEQ ID NO: 358903 - DNA, 2175 bp, Homo sapiens
gaattcccgttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggccgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcaggggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagttttataaatgtagtgataggattccttgttgcttggtccccaaagccttatactttttgcattggctttaattgggttcagcagatgcctcctctgcccccctgcaggcaggcccaaaattaggatttggtcgtgagggattttagtcttttgaacaattgtcaaagaacatttattctcgaaactaaa

SEQ ID NO: 358904 - DNA, 1929 bp, Homo sapiens
gaattcccgttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgcagtaccagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcaggggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacttctggcaggtttggaaatttccaaataaatccttttgtctattggtggtgcctggacctggtcc

SEQ ID NO: 358905 - DNA, 1454 bp, Homo sapiens
gaattcccgttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgcagtaccagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcaggggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacagtttcagcacgaattcccttagcaccagcacgaattcccttagcaccagcacgaattcccttagcaccagcacgacatcccttagcaccagcacgaactccctt

SEQ ID NO: 358906 - DNA, 906 bp, Homo sapiens
gaattcccgttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgcagtaccaggtgagcaaggaggacgcgagcggacgggggcgagaggcgctgcgagggcgcccgggccggcggctgaaggggcctcgagtgagggccctggggaatgcatgaggaactccgggagacggtggagggcgggccgggaccctcgggctgcggcgggtcgcggtggagaagtgggaaggggaagcaggttctgcagcggagggctggaagcagctgggaggcctgggggcttccgcggcacagggattccgagtgactgggagatggaggagtttggggagccagtgaattgtggcgggtgggttgagaagtctagggtaggagggctggaaagtgatgagaaagtttgggaaagggccctcgctgag

SEQ ID NO: 358907 - DNA, 368 bp, Homo sapiens
agggaggggggcgctgctccaagcccgttggaggttgatttgtgtggttattacagtgttcctgcagatggcagtcgagtgtctcgaggaagtccctcgtgggctgcaagagggcaccatttccctgcctccagtctgcccagagtcctgcttccatccttcagggcccaggaatcttcagtatccggagctccagggctgaaatggggcttctctttcttgggatttagcatagcttgagatttgagagctcagcagcaccatctcacacccctttccatccccagcctagcaaacagaagaggaagttttcttcattctttaagagcctcgtcattgagctggacaaggagctgtacgggcctgac

SEQ ID NO: 358908 - DNA, 2733 bp, Homo sapiens
gaattcccgttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggccgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcaggggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagttttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacttctggcaggtttggaaatttccaaataaatccttttgtctattggtggtgcctggacctggtcc

SEQ ID NO: 358909 - DNA, 1770 bp, Homo sapiens
  misc_feature (109)..(109): n is a, c, g, or t
aacgagggtctcagctcaacgatgctcagctcaacggagggtcctcagctcaacgatggtcctcagctcaacgatggtcctcagctcaacgatggtcctcagctcaccnggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagttttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacttctggcaggtttggaaatttccaaataaatccttttgtctattggtggtgcctggacctggtcc

SEQ ID NO: 358910 - DNA, 2367 bp, Homo sapiens
gaattcccgttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggccgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcaggggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagttttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttccttggtttcgcttgggcgcgtctctttggccctttggcgggcggggtc

SEQ ID NO: 358911 - DNA, 1918 bp, Homo sapiens
  misc_feature (1770)..(1771): n is a, c, g, or t
  misc_feature (1776)..(1777): n is a, c, g, or t
  misc_feature (1786)..(1786): n is a, c, g, or t
  misc_feature (1788)..(1789): n is a, c, g, or t
  misc_feature (1794)..(1794): n is a, c, g, or t
  misc_feature (1800)..(1800): n is a, c, g, or t
  misc_feature (1802)..(1802): n is a, c, g, or t
  misc_feature (1809)..(1809): n is a, c, g, or t
  misc_feature (1811)..(1811): n is a, c, g, or t
gaattcccgttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgcagtaccagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcaggggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcnncctgnngtggatggnanncctgnggaggncnagacaancngtttttaacccaggccgtgcccgaacgagcgggaccttttgcaggtgcacgcacggcgacttggagtcgggatccggcaaggcgggagttaccaccggctggggacc

SEQ ID NO: 358912 - DNA, 1502 bp, Homo sapiens
gaattcccgttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgcagtaccagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcaggggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgcctgcccagcgccgggggttaaagaggaggaagatggcagataaggttcta

SEQ ID NO: 358913 - DNA, 891 bp, Homo sapiens
gaattcccgttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgcagtaccaggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacagtatgtgtggccctgaccacctctagccttcccaggtttccttgccttccacccccttgttttccaggggccaagcaagttgggctagagccgggtttttcacatgcaggatgcagcccactagtagagtacgaactcagttgaatgtgttggggccagtatgttttaaatgaatatatgacag

SEQ ID NO: 358914 - DNA, 415 bp, Homo sapiens
gagaccattgagtccatcaaccagctgaagacccagagagatttcatgctcagttttagcaccgacccccaggacttcatccaggaatggctccgttcccagcgccgagacctcaaggtgtagtcctctttcccgaggggactcctatgtaaagctctgggtgatttttacccacagcagttcccagggtggattagcccaggggtggggattatgctatggctttcctcctggctctttgcagatcatcactgatgtgattggaaatcctgaggaggagagacgagctgctttctaccaccagccctgggcccaggaagcagtaggcaggcacatctttgccaaggtgaggctctgccctgttttccctcctttggccgtgagtagcaaaggcctgagccacttggtttctccc

SEQ ID NO: 358915 - DNA, 809 bp, Homo sapiens
tctgacttataatagatgaggttaaacagtagatggagaatcaagtaattctcctgcctcatcctcctcagtagctgggattataggcatgtgccgccacacccagctaatttttcttttcttttcttttttttttttagtagagacggggttttgccgtgttggccaggctggtctcaaactcctgacctcaaataatccgcccgcctcggcctcccaaagtggtgggattgcagacatgagccatcgtgcctggcctccagcaaggtctttatgatctatatcttgagtcgacctcctatctcattctgtaacctagaatgcctaactgtctgggaatgcagcccagtaggtttcagcctcattgtccccagcccctattcaagatgcagttgctctagttcaaatgcctctgacagttgtgcttcaccaaacctagagaatgaacaaagcgaaggacctggagttcaagaatggagggatccaactccaaggcaggaagcaggtccagaaagcaggcagggcagcagcaacagggaagaacagcttatctgatgactggctgggtgggaagcacaactgagaggacttgaaggactttggaagactaagttagctacaaagaaaactaagtattataccaaaaaaacttatccgggcgtggtgacaggcgcctgtagtcccagctactcgggaggctgaggcaggagaatggcgtgaacccggaaggcagagcttgcagtgagtccagattgcgccactgcgctccagcctgggcgacagagcaagactccgtctcagaaaaaaaa

SEQ ID NO: 358916 - DNA, 664 bp, Homo sapiens
tctgacttataatagatgaggttaaacagtagatggagaatcaagtaattctcctgcctcatcctcctcagtagctgggattataggcatgtgccgccacacccagctaatttttcttttcttttcttttttttttttagtagagacggggttttgccgtgttggccaggctggtctcaaactcctgacctcaaataatccgcccgcctcggcctcccaaagtggtgggattgcagacatgagccatcgtgcctggcctccagcaaggtctttatgatctatatcttgagtcgacctcctatctcattctgtaacctagaatgcctaactgtctgggaatgcagcccagtaggtttcagcctcattgtccccagcccctattcaagatgcagttgctctagttcaaatgcctctgacagttgtgcttcaccaaacctagagaatgaacaaagcgaaggacctggagttcaagaatggagggatccaactccaaggcaggaagcaggtccagaaagcaggcagggcagcagcaacagggaagaacagcttatctgatgactggctgggtgggaagcacaactgagaggacttgaaggactttggaagactaagttagctacaaagaaaactaagtattatacccacgccgaccctatgcagtctc

SEQ ID NO: 358917 - DNA, 1259 bp, Homo sapiens
cctgtcctccccagcctcctcgccctcctccaccccctctcccatcaccctcccctcccctcccctcccctcccccgtcctgagctcccacttccacacctactccaggctcggagccttaggaccatcacctgcccacctaagcccacggtgctccctcctgggaccccactcctgaaaccccctgcccctgcctcccccagcccggtgcgccggggctctccgcccgctccctcggtccctcctcccttgcaggcgccgtttcccggcttcgactccccgcgcgtctatccctctcctccccgcgaagtttcggggctgtcagtctgtcagtctttcaggccgtcagcacccgagctgcaggcggcgagcgccattgtgagcagagccggcggggcaggaggcccgggcgcctgggtccccgcggcgcgggcggagcggccggccagccaggttctgtggcctgatccccaggaggagctactctgggttaccatgagagagaccttggaggccctcagctccctgggattctctgtgggacagccagagatggccccccaaagtgagcccagggaaggatcccataatgcccaggagcagatgtcctcttctagggaagagagagcactgggggtgtgctcagggcacgaggcccctacaccggaggaaggtgcccacacagaacaagccgaggctccctgcagaggccaggcgtgctcagcacagaaggctcagcctgtgggtacctgcccagtttcgagaggcccgtgccatgagaccgcctggggtgagcaaggcgacctgggctgctgcccgaaggtttggccgccgcgggacacctgtttccttcccgcagtgtctgcgtccgcacagcatacccagctcggacctcctaggacagagactcagcgaacccttgctgggaaccgctgagctgaagttcttggaaggctcccacccaggtgccccgttggaaagcagatatttcccggacccagcgcggcctcaaccagggcaggaaagagtggttatttatgtacttaaagtttcattaaagttaaaatcggaaagttctggggctgctaaatgaattgggggagggaacacctgactctccttagccactgtcccacctccatccacacacagaccacccccctccacttccccttctgtcctgggtgagttacatttagccagctgctgttaattggttctcccaaataaaaatgtaatatatttattcactaagccac

SEQ ID NO: 358918 - DNA, 2242 bp, Homo sapiens
  misc_feature (2121)..(2121): n is a, c, g, or t
cctgtcctccccagcctcctcgccctcctccaccccctctcccatcaccctcccctcccctcccctcccctcccccgtcctgagctcccacttccacacctactccaggctcggagccttaggaccatcacctgcccacctaagcccacggtgctccctcctgggaccccactcctgaaaccccctgcccctgcctcccccagcccggtgcgccggggctctccgcccgctccctcggtccctcctcccttgcaggcgccgtttcccggcttcgactccccgcgcgtctatccctctcctccccgcgaagtttcggggctgtcagtctgtcagtctttcaggccgtcagcacccgagctgcaggcggcgagcgccattgtgagcagagccggcggggcaggaggcccgggcgcctgggtccccgcggcgcgggcggagcggccggccagccaggttctgtggcctgatccccaggaggagctactctgggttaccatgagagagaccttggaggccctcagctccctgggattctctgtgggacagccagagatggccccccaaagtgagcccagggaaggatcccataatgcccaggagcagatgtcctcttctagggaagagagagcactgggggtgtgctcagggcacgaggcccctacaccggaggaaggtgcccacacagaacaagccgaggctccctgcagaggccaggcgtgctcagcacagaaggctcagcctgtgggtacctgcccaggagaggagtggatgattcggaaggtgaaggtggaggacgaagatcaggaggcagaagaggaggtcgaatggccccagcatctatcgttacttcccagcccctttcccgcgcctgacctggggcatctggctgccgcgtacaaactggagccaggggccccgggggcactgagtgggctcgcgctgtctgggtggggtccgatgccggagaagccctacggctgcggggagtgtgagcggcgcttccgggaccagctgacgttgcgactgcaccagcggctgcaccggggcgagggcccctgcgcctgcccggactgcggccgcagcttcacgcagcgcgcccacatgctactgcatcagcgcagccaccgcggcgagcggcctttcccgtgctccgagtgcgacaagcgcttcagcaagaaggcccatctgacccgccacctgcgcacgcacacgggcgagcggccctacccgtgcgcggagtgcggcaagcgcttcagccagaagatccacctgggctcgcaccaaaagacccacaccggcgagcggcccttcccctgcacggaatgcgagaagcgctttcgcaagaagacgcacttgattcggcaccagcgcatccatacgggcgagaggccctaccagtgcgcacagtgcgcacgcagcttcacgcacaagcagcacttggtgcggcaccaaagggtgcaccagacggccggcccggccaggccctctcccgactcgtccgcttctcctcattccactgccccgtccccgaccccatcctttcccgggccaaagcctttcgcgtgctccgactgcggcttgagcttcggctggaaaaagaacctcgccacgcaccagtgtctgcaccgcagcgagggtcgcccctttgggtgcgatgagtgcgcactgggcgccaccgtggatgcccccgccgccaagcccctggccagcgcgcctggcggaccgggctgcggcccaggatccgatcccgtggtgccccagcgcgccccctcgggcgagcggtccttcttctgcccggactgcgggcgcggcttctcccatgggcagcacctggcgcggcacccgcgcgtgcacacgggcgaacggcccttcgcctgcacgcagtgtgaccgccgcttcggctcgcggcctaatctggtcgcccactccagggcccacagcggcgccaggcctttcgcctgcgctcagtgcggccgccgcttcagccgcaagtcgcacctgggccgccaccaggcggtgcacactggcagccgcccccacgcctgcgccgtctgcgcccgcagcttcagctccaaaaccaacctagtccgccaccaggcgatccacacaggctctccctcnttatcttcaccacgtcgtgcagggagtgttgctccctctggctggctgaaggcgacgggcctctgtagccacagcctgcactgggggtgccgtggagagcgggtgaccttcgctcgctcag

SEQ ID NO: 358919 - DNA, 2820 bp, Homo sapiens
cctgtcctccccagcctcctcgccctcctccaccccctctcccatcaccctcccctcccctcccctcccctcccccgtcctgagctcccacttccacacctactccaggctcggagccttaggaccatcacctgcccacctaagcccacggtgctccctcctgggaccccactcctgaaaccccctgcccctgcctcccccagcccggtgcgccggggctctccgcccgctccctcggtccctcctcccttgcaggcgccgtttcccggcttcgactccccgcgcgtctatccctctcctccccgcgaagtttcggggctgtcagtctgtcagtctttcaggccgtcagcacccgagctgcaggcggcgagcgccattgtgagcagagccggcggggcaggaggcccgggcgcctgggtccccgcggcgcgggcggagcggccggccagccaggttctgtggcctgatccccaggaggagctactctgggttaccatgagagagaccttggaggccctcagctccctgggattctctgtgggacagccagagatggccccccaaagtgagcccagggaaggatcccataatgcccaggagcagatgtcctcttctagggaagagagagcactgggggtgtgctcagggcacgaggcccctacaccggaggaaggtgcccacacagaacaagccgaggctccctgcagaggccaggcgtgctcagcacagaaggctcagcctgtgggtacctgcccaggagaggagtggatgattcggaaggtgaaggtggaggacgaagatcaggaggcagaagaggaggtcgaatggccccagcatctatcgttacttcccagcccctttcccgcgcctgacctggggcatctggctgccgcgtacaaactggagccaggggccccgggggcactgagtgggctcgcgctgtctgggtggggtccgatgccggagaagccctacggctgcggggagtgtgagcggcgcttccgggaccagctgacgttgcgactgcaccagcggctgcaccggggcgagggcccctgcgcctgcccggactgcggccgcagcttcacgcagcgcgcccacatgctactgcatcagcgcagccaccgcggcgagcggcctttcccgtgctccgagtgcgacaagcgcttcagcaagaaggcccatctgacccgccacctgcgcacgcacacgggcgagcggccctacccgtgcgcggagtgcggcaagcgcttcagccagaagatccacctgggctcgcaccaaaagacccacaccggcgagcggcccttcccctgcacggaatgcgagaagcgctttcgcaagaagacgcacttgattcggcaccagcgcatccatacgggcgagaggccctaccagtgcgcacagtgcgcacgcagcttcacgcacaagcagcacttggtgcggcaccaaagggtgcaccagacggccggcccggccaggccctctcccgactcgtccgcttctcctcattccactgccccgtccccgaccccatcctttcccgggccaaagcctttcgcgtgctccgactgcggcttgagcttcggctggaaaaagaacctcgccacgcaccagtgtctgcaccgcagcgagggtcgcccctttgggtgcgatgagtgcgcactgggcgccaccgtggatgcccccgccgccaagcccctggccagcgcgcctggcggaccgggctgcggcccaggatccgatcccgtggtgccccagcgcgccccctcgggcgagcggtccttcttctgcccggactgcgggcgcggcttctcccatgggcagcacctggcgcggcacccgcgcgtgcacacgggcgaacggcccttcgcctgcacgcagtgtgaccgccgcttcggctcgcggcctaatctggtcgcccactccagggcccacagcggcgccaggcctttcgcctgcgctcagtgcggccgccgcttcagccgcaagtcgcacctgggccgccaccaggcggtgcacactggcagccgcccccacgcctgcgccgtctgcgcccgcagcttcagctccaaaaccaacctagtccgccaccaggcgatccacacaggctcccgccccttctcctgcccgcagtgcggaaagagcttcagccgcaagacccacctggtgcggcaccagctcattcacggcgaagccgcccacgcggccccggacgccgcccttgcggccccagcctggtccgctccccccgaggtggcgccgcccccgctcttcttctgagcctagttctcacgaggaccctttcttgcccacagtttcgagaggcccgtgccatgagaccgcctggggtgagcaaggcgacctgggctgctgcccgaaggtttggccgccgcgggacacctgtttccttcccgcagtgtctgcgtccgcacagcatacccagctcggacctcctaggacagagactcagcgaacccttgctgggaaccgctgagctgaagttcttggaaggctcccacccaggtgccccgttggaaagcagatatttcccggacccagcgcggcctcaaccagggcaggaaagagtggttatttatgtacttaaagtttcattaaagttaaaatcggaaagttctggggctgctaaatgaattgggggagggaacacctgactctccttagccactgtcccacctccatccacacacagaccacccccctccacttccccttctgtcctgggtgagttacatttagccagctgctgttaattggttctcccaaataaaaatgtaatatatttattcactaagccac

SEQ ID NO: 358920 - DNA, 2199 bp, Homo sapiens
cttgaggtatcctattctctgccagggcacgaggcccctacaccggaggaaggtgcccacacagaacaagccgaggctccctgcagaggccaggcgtgctcagcacagaaggctcagcctgtgggtacctgcccaggagaggagtggatgattcggaaggtgaaggtggaggacgaagatcaggaggcagaagaggaggtcgaatggccccagcatctatcgttacttcccagcccctttcccgcgcctgacctggggcatctggctgccgcgtacaaactggagccaggggccccgggggcactgagtgggctcgcgctgtctgggtggggtccgatgccggagaagccctacggctgcggggagtgtgagcggcgcttccgggaccagctgacgttgcgactgcaccagcggctgcaccggggcgagggcccctgcgcctgcccggactgcggccgcagcttcacgcagcgcgcccacatgctactgcatcagcgcagccaccgcggcgagcggcctttcccgtgctccgagtgcgacaagcgcttcagcaagaaggcccatctgacccgccacctgcgcacgcacacgggcgagcggccctacccgtgcgcggagtgcggcaagcgcttcagccagaagatccacctgggctcgcaccaaaagacccacaccggcgagcggcccttcccctgcacggaatgcgagaagcgctttcgcaagaagacgcacttgattcggcaccagcgcatccatacgggcgagaggccctaccagtgcgcacagtgcgcacgcagcttcacgcacaagcagcacttggtgcggcaccaaagggtgcaccagacggccggcccggccaggccctctcccgactcgtccgcttctcctcattccactgccccgtccccgaccccatcctttcccgggccaaagcctttcgcgtgctccgactgcggcttgagcttcggctggaaaaagaacctcgccacgcaccagtgtctgcaccgcagcgagggtcgcccctttgggtgcgatgagtgcgcactgggcgccaccgtggatgcccccgccgccaagcccctggccagcgcgcctggcggaccgggctgcggcccaggatccgatcccgtggtgccccagcgcgccccctcgggcgagcggtccttcttctgcccggactgcgggcgcggcttctcccatgggcagcacctggcgcggcacccgcgcgtgcacacgggcgaacggcccttcgcctgcacgcagtgtgaccgccgcttcggctcgcggcctaatctggtcgcccactccagggcccacagcggcgccaggcctttcgcctgcgctcagtgcggccgccgcttcagccgcaagtcgcacctgggccgccaccaggcggtgcacactggcagccgcccccacgcctgcgccgtctgcgcccgcagcttcagctccaaaaccaacctagtccgccaccaggcgatccacacaggctcccgccccttctcctgcccgcagtgcggaaagagcttcagccgcaagacccacctggtgcggcaccagctcattcacggcgaagccgcccacgcggccccggacgccgcccttgcggccccagcctggtccgctccccccgaggtggcgccgcccccgctcttcttctgagcctagttctcacgaggaccctttcttgcccacagtttcgagaggcccgtgccatgagaccgcctggggtgagcaaggcgacctgggctgctgcccgaaggtttggccgccgcgggacacctgtttccttcccgcagtgtctgcgtccgcacagcatacccagctcggacctcctaggacagagactcagcgaacccttgctgggaaccgctgagctgaagttcttggaaggctcccacccaggtgccccgttggaaagcagatatttcccggacccagcgcggcctcaaccagggcaggaaagagtggttatttatgtacttaaagtttcattaaagttaaaatcggaaagttctggggctgctaaatgaattgggggagggaacacctgactctccttagccactgtcccacctccatccacacacagaccacccccctccacttccccttctgtcctgggtgagttacatttagccagctgctgttaattggttctcccaaataaaaatgtaatatatttattcactaagccac

SEQ ID NO: 358921 - DNA, 538 bp, Homo sapiens
gcccccgggagccgtgtggtgttcacacgcatcacaggttcaggagaatgcaggagggggcctgagaagagctgcggatttggtcactcccgggaagcgttaggtagagtggagagcagagccagaccgcggggctccaggaagtggagatcctgtggttaaatagacgttgccgcacgtggagctcaatagacaattcttgttttgactttccaggagaggagtggatgattcggaaggtgaaggtggaggacgaagatcaggaggcagaagaggaggtcgaatggccccagcatctatcgttacttcccagcccctttcccgcgcctgacctggggcatctggctgccgcgtacaaactggagccaggggccccgggggcactgagtgggctcgcgctgtctgggtggggtccgatgccggagaagccctacggctgcggggagtgtgagcggcgcttccgggaccagctgacgttgcgactgcaccagcggctgcaccggggcgagggcccctgcgcctgcccggactgcggccg

SEQ ID NO: 358922 - DNA, 207 bp, Homo sapiens
gacttcctgactccagatcttttttttctttccatgacatcacattgctgccttaattcatttgcacaatgcatgattgtatggccagtgttcactgacacctttcctacagaagtatcaatgagcccaggcattacgtagagccatgtggagaagaaaataattcataccttcagaggagcttccattttagtgggggttgataca

SEQ ID NO: 358923 - DNA, 453 bp, Homo sapiens
gtgagtattctttgtgagatagctatcagggctagagatacattaggatggtgaacttttttggggagtaagaatccccaaagtagagatgagtgtaaatgaccttgctttgtggttcactctaggagaattcttcaggccccatgactactgtccgagttagcctacggtgtcctttgagactgcctggccttttggtgtttcaaggcatgttaaagggaatgatctgctggggttgtcttagaatacttcaaagtagctgggtacagtggctcacacctgtgatcctagcatgttgggaggccaaggtagaaagattgcttgaacccaggagttcgagtgcagcctggacaacatagtgagatctcccatctctacaaaaaaacacccagaatacttgaaagcaatagttgagcaacctctttttgtaatctgttaggattatcagtagta

SEQ ID NO: 358924 - DNA, 396 bp, Homo sapiens
ctttcctgtttcactgccttggcactggaaaatatggggtaaaatgttgttaacattaacacaaatatatttatcatgaagagtaaatctaatctcttatgtacagtgttttaaaaaaatcaagttctggccaggcgcagtgtttcacgcctgtaatcccagcactttgggaggccgaggtgggcggatcaggaggtcaagagatcgagaccattctggctaacatggtgaaaccccgtctctactaaaaatacaaaattagctgggtgtggtggcgcgtgcctgtagtcccagctacttgtgaggctgaggcagaagaatcgctgaaacccgggaggcggaggttgcagtgagccaagatcgcgccagtgcactccggcctagcgacagagcgag

SEQ ID NO: 358925 - DNA, 855 bp, Homo sapiens
attgtgtgacacttgatagttattagaaagaggcagatcagggcaaaaacatttggaaaggatgatctcatctgtataaaagttctaagatgatacacaagaaatggtaattctgtagcttctagagagctttatgtatagtttgtacactgaataaatgtaattggccatccgtatgacaggaagacaagggttttggtcggcagccatctcaaggtgatccattgagacaaggtgccaagacctgaacaaggctgccgccgccccagcttgcattaagagaggaagagcatcctggcctcctccatactggtcacaccatgtgtgtctggggtccctcagtagctctgagggccgctctcttaagagcatagcacactgaagctcccctaccacacacaggaagccggagcagctccaggtccaacaggaactgacagccacgaggtggaccacctggagggcggtgcggggaaggaggcagggccctgtgcctgaagcctgggcaccatggtggccccagtcaggagcaacagtggtagccctgagtaaaacccattgtccctctttggaggagcggccagaggatgacagcagccccagcaggcagcagtgcctgggcaggctgatccagcagagcactaatgggtcagtttcatgtattggcagatgtggtgtagcatggcaaggctacaagttttaaggatttttgtctgattttcagacctggaggaggggatttttcttcctactttcccccttttttatttctaatttactttcaaccaaatattcccactatgtgctatatgtaataataaaaagttgacaacaactgaaaaatcaacagcagag

SEQ ID NO: 358926 - DNA, 6337 bp, Homo sapiens
cgccgctcaggccctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcaggtccctctgctggctccggttctgcgaggttcagccggaggcccacctgtcctgacacatctgttgctggcagcctccccacacctccagtccccagacacaggaagagccacagcctaggcaacaatatgatgtgtcagttgagtgtagttgagagtaaaagtgcgacattcccatcggagaaagcaaggcacctactggacgacagtgtcctagagtcccgcagcccccgaaggggcctggctctgacctcctcctctgctgtcaccaatggactctccctaggcagtagtgagagctcagagtttagtgaagagatgtcttcagggctggaaagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacactataaatccacacctggcaaaaaggtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggtacctgcaaaccttatgtcatttgagtaagtctctgcaggacgtggcatgacttcagaggcttctgggaacccaggctgggcctggtggtgaagagcagtcctgggcacaggctgtgagccagggtgctgggaaactcacagctggactcaggggacacggcctgtggcctcaccatcccagagggcttcaccagtgtgggatccacctgtcagtccccagcgactctcatgacactcattctgcagcaccgcctcttggggcagtggtcagaccccacacgccctctctgggcccaccacctgcatctgcgactagagagcacccggcccacgttgggttctcagtgctttctactgcacagagtggacagcgctaactaacctgtgagaggggcccgagagaaggaacagctgtggaacaggctttttacaccccaagtgcatggggttgctcgcccacagggctgcctcagattttgtacaaccccgaagcgtcctctgcgtgtgcgtgctgtacgtgtgtgtgtgtgtgtgagcgagtgtgaactcttcaagaaacatgcattttggcacaagactcgtgacatcacacacttcattcgctttgaggccctgctttaaccttaagttatagccctgtccaccgaggaaggtcagggtgagagcctagattcctcctgtgtcaagggtccctcgcattcttttactgtaaacaaacaatgccttaaattgtgtcttgttttctgttcctatgggtgctattcatctggaaggcctgcttccaggcctctttgctgtcagcccttctgagacaggacctggcttcaggactgtggactgggctgctggcctgcttgcttcctcccttccccattcctagcagggcctgaggccctcctcttctcgcccttcccaccatgccagaatgggaagttgtgacgttgcagctccaaccgacgtgctcatagtgatcagctgtgcaggagccatgaggcaccaacctctccccgcagggcaaagcctgtgcccccatcatctcactcctttgcctgcactgccagggtggggcccaccaagattcctgatcatgacgggaagctgagtgaccctgaggccttaagcttccccagtcttggccccaaatgcagtcaccagcaagttttccattttccaagtccaagggcacaattgttgatgaccgtgtgacaatagagcgaagccccggggagtgaacggtccaacctctgcattcagttaggagctcttcacatgaatcacatccttatctgtcaccttgtgtcacattttaaagtgacttttattttgcacaaataatttttattcagaataataaatcactctttatcatagtatcttctcttccctcttcccctttagtttggatagcctaactctgagaagttaacccttaaacagttttctggaagagactgaatttctgggtccttgcagctgtgatggtttcagagctcagactgatcaggcatcaagctaccctcaagagtttctgggctggatgtttcagaacaacatctacaccagtaaagtgtaataggtcagtttcaaaacgaccaaaagacccaccactgtattttgaccaaataatgacaacttctttagaaatttgaatggcttggtgaggaaagtagttgtcaccagggcctcattttgtagttgagccttacaatgcttagtagttcatcttctttttgagcaaagactagaatactttcctcctaagagaaactcccaggtgataaaagttgatgccatcaaaccttgacaccgggtgctctgcacacccacgcggatgttgcacctcattctcccgatgactattcaaatcagcatctagaggctgaatgacaatgccaaacactccacctctgatcagaaccatgcagtgttaacactttaacctacattgaatctgattctacctgttaacttttaaaaagtcgtaagtttggatgaaagtgcaagatgtggaacatcaactacctattttccttgggtttttccactctgcaaactgtcctggtttttcacaccaatgaagtattatagatgccaatccaaaacctcagaatttcaggcaccacaaaaacaggtaattttctatcccttataagtttgtcttttctttcagaaacatctcttagcctaatttgaaatagcacaatcacaattcaaaatgtttagtcttctcactaattgagtctgcttccacgtcctctcccaggaacattcttagctcggactcttgaagaatctctttagattttgttggcaaaagccttatagaagcagtaagaggcttgaccacgccggaagagtcctggagctaaagctggaagacactcagctctctaagcaggggctcggccaaacatgggagttaagtgctgcttgtcttcccagtgttggtttgaaccctgtgagcctgagacagagagggccaggcaccaaccacaaggcgggaaagtccatgggtagaccctccccctggagggaagcatttctagtttttgctccttgactgtccagagtgtacaaatgttcataacgccattgaagggattatttcttgcatgcatatgctgaatttttttaagcaaatggatcatggcaccccaaaatgaaagttatagaaagctgtctacaactgtggagttggtagctggtaacattgttgtctcaagaacaactcacctctctccctaggactaatttttgtctctctcagttgaacatgttttgtcattcaagatcagtcaggtgcattctggcaactgacatacttgatggaggattgattcggtagagagcagtagaaatcttgttctaactgtgcctggtgagagactttggccccctccctccctataaggctgtggaacctgaggaagtagatacttgaagagattctgtttaggaagaaactcactctcttttgccagttgaatttatagagcattttttttcttaccaagatggccagtatcattttacccccacctcccaagccccaagaggtgtaccttttcagatgccattttacaggcggaaatgctccatgaaacaggaagccacttgcaagcaacatctgctctgttcctcaggtggggcccagagcccttccccgagactgctgatgtctgtaaccactggggagcactgccaaaaatacagctttctggtttgtgagcccataaatgacttaaatcagctttacatcatttttacatatcaagtggtttcatgttaaaaaacaaactcctagtcctttagaaataacagattctctgcacaaaaccacccattcattcatttattcattcacagcactagcaagtgctgcctatgctgagaacaagtcagatctgatccctgccctcatggacctgaccactcaacaaacagtccccaccacacctatctccttaggcaagactttgcctctctcctagtcctgagtataaatcctgtgcatagattcctctagaaaggcatcaaaaggctcaacagactgaatggcctcttggtctgcgaaaattcagttgcaatgaggatgaagtcactatcctagaggctgcttggcccagaagagccaggcacagagctgcagttgggcacgccaaggattccaaaggtggaatgagagagtagggtcaaactgtcacagtatctgctccataggtttctgtttttaatttcaatgttaaatacaactacaatatgagcgagaactgcattttcttgggtgttgagaacttgtaccatggacttcagaccgccttgcagccgtatgctgcacaagcgtgtacaccccctgggcagcctcaaaaccccgcttacagcagcaacacaggagatcatctgtccattttagaaccattaatctctttatccattgctgaacgactgtgactattcagtaacgaagtaatagtaattaattagtatggtataatctttaataaatttcgtgccaaaatgcatggttttccacttagcattcaaaatgttgcatagagagtagttttcaatttcttatgtactcttcgaagtaagttgaaaatcagtttctacattttaattcgtttcctgttaaatctgttgcactctcctgggctgtctttttctccagcagacccctgcatgcagttgtgtaaggactttctctaattcttgtgaatcgtctcacccgcagtaaccactgaacgtcaatcagccctccatggggttctttcgatttttggtgaagtattttgttacctcagtcttgtatcaagttgctgtatttttcagcttgttacattgataataattatttcactaattaaatactttaatgtacaaacatctttgtttactttgaaattaaatgtgttttccaatga

SEQ ID NO: 358927 - DNA, 740 bp, Homo sapiens
aaatgttagcaatacctgtgatttttatctccaagaggaatcacatattgttacagacatttcaaaatgtcacttatgctcatctcttttacagtgcagtatcggaccgtactagatctgtttttagtgctttaatatagaagcacctatagaattatactgctggtttgttttttagttgtttaataactgtatttgagtattatcgatttcctttgtattttatacatttggaaacattattctgaggattgtccacaggcttaaccagacagccaaaggcaccatggccccaaaatggttacaagccatggtccaaagagaccactggagggagccctggaggctgctttctctgcatgttccagctcacctggggccgaccttcccactttagttacccgtgtttacatttctctttatgccagtcaccagctgaccctcctacgtggccctcttcttaactcatggtttctctacccatcaggcaatgtttacaagtttcagactggttcccgatttcatgcaatactgtggcacaagcatttggatgatgcatgtaaaagcaacaggcctcaggtaaagtcatcaaaatcctgcttgtcacctgaaatatcctctcccacccttggaactaagggtctttagaaaacagggttcccttcttctttcagagcccattagccacactctcagataccctcttctgatcagcatcttcccttgagacaaggcacccc

SEQ ID NO: 358928 - DNA, 751 bp, Homo sapiens
cgccgctcaggccctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggagaaaggctggcctgccagaatggaagactccctgcagaagtccacagtttcctccaggccacatgacacgttgcagttcaggaaaacactgcctgtgggtccaggaacctgaccctctggccttttgtctggatgccgtttgcctgctctgaagaagcgggcgttccagaaagccgaggtcaatgttggacgtcggacaaaccctgtgtgtctttgctgctccttggaatca

SEQ ID NO: 358929 - DNA, 6248 bp, Homo sapiens
cgccgctcaggccctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcaggtccctctgctggctccggttctgcgaggttcagccggaggcccacctgtcctgacacatctgttgctggcagcctccccacacctccagtccccagacacaggaagagccacagcctaggcaacaacaggggacgtctctatgccaccctggggcccaactggcgggttccagttaggaattctcccagaacccggagctgtgtctacagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacactataaatccacacctggcaaaaaggtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggtacctgcaaaccttatgtcatttgagtaagtctctgcaggacgtggcatgacttcagaggcttctgggaacccaggctgggcctggtggtgaagagcagtcctgggcacaggctgtgagccagggtgctgggaaactcacagctggactcaggggacacggcctgtggcctcaccatcccagagggcttcaccagtgtgggatccacctgtcagtccccagcgactctcatgacactcattctgcagcaccgcctcttggggcagtggtcagaccccacacgccctctctgggcccaccacctgcatctgcgactagagagcacccggcccacgttgggttctcagtgctttctactgcacagagtggacagcgctaactaacctgtgagaggggcccgagagaaggaacagctgtggaacaggctttttacaccccaagtgcatggggttgctcgcccacagggctgcctcagattttgtacaaccccgaagcgtcctctgcgtgtgcgtgctgtacgtgtgtgtgtgtgtgtgagcgagtgtgaactcttcaagaaacatgcattttggcacaagactcgtgacatcacacacttcattcgctttgaggccctgctttaaccttaagttatagccctgtccaccgaggaaggtcagggtgagagcctagattcctcctgtgtcaagggtccctcgcattcttttactgtaaacaaacaatgccttaaattgtgtcttgttttctgttcctatgggtgctattcatctggaaggcctgcttccaggcctctttgctgtcagcccttctgagacaggacctggcttcaggactgtggactgggctgctggcctgcttgcttcctcccttccccattcctagcagggcctgaggccctcctcttctcgcccttcccaccatgccagaatgggaagttgtgacgttgcagctccaaccgacgtgctcatagtgatcagctgtgcaggagccatgaggcaccaacctctccccgcagggcaaagcctgtgcccccatcatctcactcctttgcctgcactgccagggtggggcccaccaagattcctgatcatgacgggaagctgagtgaccctgaggccttaagcttccccagtcttggccccaaatgcagtcaccagcaagttttccattttccaagtccaagggcacaattgttgatgaccgtgtgacaatagagcgaagccccggggagtgaacggtccaacctctgcattcagttaggagctcttcacatgaatcacatccttatctgtcaccttgtgtcacattttaaagtgacttttattttgcacaaataatttttattcagaataataaatcactctttatcatagtatcttctcttccctcttcccctttagtttggatagcctaactctgagaagttaacccttaaacagttttctggaagagactgaatttctgggtccttgcagctgtgatggtttcagagctcagactgatcaggcatcaagctaccctcaagagtttctgggctggatgtttcagaacaacatctacaccagtaaagtgtaataggtcagtttcaaaacgaccaaaagacccaccactgtattttgaccaaataatgacaacttctttagaaatttgaatggcttggtgaggaaagtagttgtcaccagggcctcattttgtagttgagccttacaatgcttagtagttcatcttctttttgagcaaagactagaatactttcctcctaagagaaactcccaggtgataaaagttgatgccatcaaaccttgacaccgggtgctctgcacacccacgcggatgttgcacctcattctcccgatgactattcaaatcagcatctagaggctgaatgacaatgccaaacactccacctctgatcagaaccatgcagtgttaacactttaacctacattgaatctgattctacctgttaacttttaaaaagtcgtaagtttggatgaaagtgcaagatgtggaacatcaactacctattttccttgggtttttccactctgcaaactgtcctggtttttcacaccaatgaagtattatagatgccaatccaaaacctcagaatttcaggcaccacaaaaacaggtaattttctatcccttataagtttgtcttttctttcagaaacatctcttagcctaatttgaaatagcacaatcacaattcaaaatgtttagtcttctcactaattgagtctgcttccacgtcctctcccaggaacattcttagctcggactcttgaagaatctctttagattttgttggcaaaagccttatagaagcagtaagaggcttgaccacgccggaagagtcctggagctaaagctggaagacactcagctctctaagcaggggctcggccaaacatgggagttaagtgctgcttgtcttcccagtgttggtttgaaccctgtgagcctgagacagagagggccaggcaccaaccacaaggcgggaaagtccatgggtagaccctccccctggagggaagcatttctagtttttgctccttgactgtccagagtgtacaaatgttcataacgccattgaagggattatttcttgcatgcatatgctgaatttttttaagcaaatggatcatggcaccccaaaatgaaagttatagaaagctgtctacaactgtggagttggtagctggtaacattgttgtctcaagaacaactcacctctctccctaggactaatttttgtctctctcagttgaacatgttttgtcattcaagatcagtcaggtgcattctggcaactgacatacttgatggaggattgattcggtagagagcagtagaaatcttgttctaactgtgcctggtgagagactttggccccctccctccctataaggctgtggaacctgaggaagtagatacttgaagagattctgtttaggaagaaactcactctcttttgccagttgaatttatagagcattttttttcttaccaagatggccagtatcattttacccccacctcccaagccccaagaggtgtaccttttcagatgccattttacaggcggaaatgctccatgaaacaggaagccacttgcaagcaacatctgctctgttcctcaggtggggcccagagcccttccccgagactgctgatgtctgtaaccactggggagcactgccaaaaatacagctttctggtttgtgagcccataaatgacttaaatcagctttacatcatttttacatatcaagtggtttcatgttaaaaaacaaactcctagtcctttagaaataacagattctctgcacaaaaccacccattcattcatttattcattcacagcactagcaagtgctgcctatgctgagaacaagtcagatctgatccctgccctcatggacctgaccactcaacaaacagtccccaccacacctatctccttaggcaagactttgcctctctcctagtcctgagtataaatcctgtgcatagattcctctagaaaggcatcaaaaggctcaacagactgaatggcctcttggtctgcgaaaattcagttgcaatgaggatgaagtcactatcctagaggctgcttggcccagaagagccaggcacagagctgcagttgggcacgccaaggattccaaaggtggaatgagagagtagggtcaaactgtcacagtatctgctccataggtttctgtttttaatttcaatgttaaatacaactacaatatgagcgagaactgcattttcttgggtgttgagaacttgtaccatggacttcagaccgccttgcagccgtatgctgcacaagcgtgtacaccccctgggcagcctcaaaaccccgcttacagcagcaacacaggagatcatctgtccattttagaaccattaatctctttatccattgctgaacgactgtgactattcagtaacgaagtaatagtaattaattagtatggtataatctttaataaatttcgtgccaaaatgcatggttttccacttagcattcaaaatgttgcatagagagtagttttcaatttcttatgtactcttcgaagtaagttgaaaatcagtttctacattttaattcgtttcctgttaaatctgttgcactctcctgggctgtctttttctccagcagacccctgcatgcagttgtgtaaggactttctctaattcttgtgaatcgtctcacccgcagtaaccactgaacgtcaatcagccctccatggggttctttcgatttttggtgaagtattttgttacctcagtcttgtatcaagttgctgtatttttcagcttgttacattgataataattatttcactaattaaatactttaatgtacaaacatctttgtttactttgaaattaaatgtgttttccaatga

SEQ ID NO: 358930 - DNA, 6414 bp, Homo sapiens
cgccgctcaggccctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcaggtccctctgctggctccggttctgcgaggttcagccggaggcccacctgtcctgacacatctgttgctggcagcctccccacacctccagtccccagacacaggaagagccacagcctaggcaacaatatgatgtgtcagttgagtgtagttgagagtaaaagtgcgacattcccatcggagaaagcaaggcacctactggacgacagtgtcctagagtcccgcagcccccgaaggggcctggctctgacctcctcctctgctgtcaccaatggactctccctaggcagtagtgagagctcagagtttagtgaagagatgtcttcagggctggaaagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacactataaatccacacctggcaaaaaggtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggtacctgcaaaccttatgtcatttgagtaagtctctgcaggacgtggcatgacttcagaggcttctgggaacccaggctgggcctggtggtgaagagcagtcctgggcacaggctgtgagccagggtgctgggaaactcacagctggactcaggggacacggcctgtggcctcaccatcccagagggcttcaccagtgtgggatccacctgtcagtccccagcgactctcatgacactcattctgcagcaccgcctcttggggcagtggtcagaccccacacgccctctctgggcccaccacctgcatctgcgactagagagcacccggcccacgttgggttctcagtgctttctactgcacagagtggacagcgctaactaacctgtgagaggggcccgagagaaggaacagctgtggaacaggctttttacaccccaagtgcatggggttgctcgcccacagggctgcctcagattttgtacaaccccgaagcgtcctctgcgtgtgcgtgctgtacgtgtgtgtgtgtgtgtgagcgagtgtgaactcttcaagaaacatgcattttggcacaagactcgtgacatcacacacttcattcgctttgaggccctgctttaaccttaagttatagccctgtccaccgaggaaggtcagggtgagagcctagattcctcctgtgtcaagggtccctcgcattcttttactgtaaacaaacaatgccttaaattgtgtcttgttttctgttcctatgggtgctattcatctggaaggcctgcttccaggcctctttgctgtcagcccttctgagacaggacctggcttcaggactgtggactgggctgctggcctgcttgcttcctcccttccccattcctagcagggcctgaggccctcctcttctcgcccttcccaccatgccagaatgggaagttgtgacgttgcagctccaaccgacgtgctcatagtgatcagctgtgcaggagccatgaggcaccaacctctccccgcagggcaaagcctgtgcccccatcatctcactcctttgcctgcactgccagggtggggcccaccaagattcctgatcatgacgggaagctgagtgaccctgaggccttaagcttccccagtcttggccccaaatgcagtcaccagcaagttttccattttccaagtccaagggcacaattgttgatgaccgtgtgacaatagagcgaagccccggggagtgaacggtccaacctctgcattcagttaggagctcttcacatgaatcacatccttatctgtcaccttgtgtcacattttaaagtgacttttattttgcacaaataatttttattcagaataataaatcactctttatcatagtatcttctcttccctcttcccctttagtttggatagcctaactctgagaagttaacccttaaacagttttctggaagagactgaatttctgggtccttgcagctgtgatggtttcagagctcagactgatcaggcatcaagctaccctcaagagtttctgggctggatgtttcagaacaacatctacaccagtaaagtgtaataggtcagtttcaaaacgaccaaaagacccaccactgtattttgaccaaataatgacaacttctttagaaatttgaatggcttggtgaggaaagtagttgtcaccagggcctcattttgtagttgagccttacaatgcttagtagttcatcttctttttgagcaaagactagaatactttcctcctaagagaaactcccaggtgataaaagttgatgccatcaaaccttgacaccgggtgctctgcacacccacgcggatgttgcacctcattctcccgatgactattcaaatcagcatctagaggctgaatgacaatgccaaacactccacctctgatcagaaccatgcagtgttaacactttaacctacattgaatctgattctacctgttaacttttaaaaagtcgtaagtttggatgaaagtgcaagatgtggaacatcaactacctattttccttgggtttttccactctgcaaactgtcctggtttttcacaccaatgaagtattatagatgccaatccaaaacctcagaatttcaggcaccacaaaaacaggtaattttctatcccttataagtttgtcttttctttcagaaacatctcttagcctaatttgaaatagcacaatcacaattcaaaatgtttagtcttctcactaattgagtctgcttccacgtcctctcccaggaacattcttagctcggactcttgaagaatctctttagattttgttggcaaaagccttatagaagcagtaagaggcttgaccacgccggaagagtcctggagctaaagctggaagacactcagctctctaagcaggggctcggccaaacatgggagttaagtgctgcttgtcttcccagtgttggtttgaaccctgtgagcctgagacagagagggccaggcaccaaccacaaggcgggaaagtccatgggtagaccctccccctggagggaagcatttctagtttttgctccttgactgtccagagtgtacaaatgttcataacgccattgaagggattatttcttgcatgcatatgctgaatttttttaagcaaatggatcatggcaccccaaaatgaaagttatagaaagctgtctacaactgtggagttggtagctggtaacattgttgtctcaagaacaactcacctctctccctaggactaatttttgtctctctcagttgaacatgttttgtcattcaagatcagtcaggtgcattctggcaactgacatacttgatggaggattgattcggtagagagcagtagaaatcttgttctaactgtgcctggtgagagactttggccccctccctccctataaggctgtggaacctgaggaagtagatacttgaagagattctgtttaggaagaaactcactctcttttgccagttgaatttatagagcattttttttcttaccaagatggccagtatcattttacccccacctcccaagccccaagaggtgtaccttttcagatgccattttacaggcggaaatgctccatgaaacaggaagccacttgcaagcaacatctgctctgttcctcaggtggggcccagagcccttccccgagactgctgatgtctgtaaccactggggagcactgccaaaaatacagctttctggtttgtgagcccataaatgacttaaatcagctttacatcatttttacatatcaagtggtttcatgttaaaaaacaaactcctagtcctttagaaataacagattctctgcacaaaaccacccattcattcatttattcattcacagcactagcaagtgctgcctatgctgagaacaagtcagatctgatccctgccctcatggacctgaccactcaacaaacagtccccaccacacctatctccttaggcaagactttgcctctctcctagtcctgagtataaatcctgtgcatagattcctctagaaaggcatcaaaaggctcaacagactgaatggcctcttggtctgcgaaaattcagttgcaatgaggatgaagtcactatcctagaggctgcttggcccagaagagccaggcacagagctgcagttgggcacgccaaggattccaaaggtggaatgagagagtagggtcaaactgtcacagtatctgctccataggtttctgtttttaatttcaatgttaaatacaactacaatatgagcgagaactgcattttcttgggtgttgagaacttgtaccatggacttcagaccgccttgcagccgtatgctgcacaagcgtgtacaccccctgggcagcctcaaaaccccgcttacagcagcaacacaggagatcatctgtccattttagaaccattaatctctttatccattgctgaacgactgtgactattcagtaacgaagtaatagtaattaattagtatggtataatctttaataaatttcgtgccaaaatgcatggttttccacttagcattcaaaatgttgcatagagagtagttttcaatttcttatgtactcttcgaagtaagttgaaaatcagtttctacattttaattcgtttcctgttaaatctgttgcactctcctgggctgtctttttctccagcagacccctgcatgcagttgtgtaaggactttctctaattcttgtgaatcgtctcacccgcagtaaccactgaacgtcaatcagccctccatggggttctttcgatttttggtgaagtattttgttacctcagtcttgtatcaagttgctgtatttttcagcttgttacattgataataattatttcactaattaaatactttaatgtacaaacatctttgtttactttgaaattaaatgtgttttccaatgaatgttgctcagtttattaaagtcacacacattcacttagc

SEQ ID NO: 358931 - DNA, 6284 bp, Homo sapiens
cgccgctcaggccctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcaggtccctctgctggctccggttctgcgaggttcagccggaggcccacctgtcctgacacatctgttgctggcagcctccccacacctccagtccccagacacaggaagagccacagcctaggcaacaatatgatgtgtcagttgagtgtagttgagagtaaaagtgcgacattcccatcggagaaagcaaggcacctactggacgacagtgtcctagagtcccgcagcccccgaaggggcctggctctgacctcctcctctgctgtcaccaatggactctccctaggcagtagtgagagctcagagtttagtgaagagatgtcttcagggctggaaagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacactataaatccacacctggcaaaaaggtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggtacctgcaaaccttatgtcatttgagtaagtctctgcaggacgtggcatgacttcagaggcttctgggaacccaggctgggcctggtggtgaagagcagtcctgggcacaggctgtgagccagggtgctgggaaactcacagctggactcaggggacacggcctgtggcctcaccatcccagagggcttcaccagtgtgggatccacctgtcagtccccagcgactctcatgacactcattctgcagcaccgcctcttggggcagtggtcagaccccacacgccctctctgggcccaccacctgcatctgcgactagagagcacccggcccacgttgggttctcagtgctttctactgcacagagtggacagcgctaactaacctgtgagaggggcccgagagaaggaacagctgtggaacaggctttttacaccccaagtgcatggggttgctcgcccacagggctgcctcagattttgtacaaccccgaagcgtcctctgcgtgtgcgtgctgtacgtgtgtgtgtgtgtgtgagcgagtgtgaactcttcaagaaacatgcattttggcacaagactcgtgacatcacacacttcattcgctttgaggccctgctttaaccttaagttatagccctgtccaccgaggaaggtcagggtgagagcctagattcctcctgtgtcaagggtccctcgcattcttttactgtaaacaaacaatgccttaaattgtgtcttgttttctgttcctatgggtgctattcatctggaaggcctgcttccaggcctctttgctgtcagcccttctgagacaggacctggcttcaggactgtggactgggctgctggcctgcttgcttcctcccttccccattcctagcagggcctgaggccctcctcttctcgcccttcccaccatgccagaatgggaagttgtgacgttgcagctccaaccgacgtgctcatagtgatcagctgtgcaggagccatgaggcaccaacctctccccgcagggcaaagcctgtgcccccatcatctcactcctttgcctgcactgccagggtggggcccaccaagattcctgatcatgacgggaagctgagtgaccctgaggccttaagcttccccagtcttggccccaaatgcagtcaccagcaagttttccattttccaagtccaagggcacaattgttgatgaccgtgtgacaatagagcgaagccccggggagtgaacggtccaacctctgcattcagttaggagctcttcacatgaatcacatccttatctgtcaccttgtgtcacattttaaagtgacttttattttgcacaaataatttttattcagaataataaatcactctttatcatagtatcttctcttccctcttcccctttagtttggatagcctaactctgagaagttaacccttaaacagttttctggaagagactgaatttctgggtccttgcagctgtgatggtttcagagctcagactgatcaggcatcaagctaccctcaagagtttctgggctggatgtttcagaacaacatctacaccagtaaagtgtaataggtcagtttcaaaacgaccaaaagacccaccactgtattttgaccaaataatgacaacttctttagaaatttgaatggcttggtgaggaaagtagttgtcaccagggcctcattttgtagttgagccttacaatgcttagtagttcatcttctttttgagcaaagactagaatactttcctcctaagagaaactcccaggtgataaaagttgatgccatcaaaccttgacaccgggtgctctgcacacccacgcggatgttgcacctcattctcccgatgactattcaaatcagcatctagaggctgaatgacaatgccaaacactccacctctgatcagaaccatgcagtgttaacactttaacctacattgaatctgattctacctgttaacttttaaaaagtcgtaagtttggatgaaagtgcaagatgtggaacatcaactacctattttccttgggtttttccactctgcaaactgtcctggtttttcacaccaatgaagtattatagatgccaatccaaaacctcagaatttcaggcaccacaaaaacaggtaattttctatcccttataagtttgtcttttctttcagaaacatctcttagcctaatttgaaatagcacaatcacaattcaaaatgtttagtcttctcactaattgagtctgcttccacgtcctctcccaggaacattcttagctcggactcttgaagaatctctttagattttgttggcaaaagccttatagaagcagtaagaggcttgaccacgccggaagagtcctggagctaaagctggaagacactcagctctctaagcaggggctcggccaaacatgggagttaagtgctgcttgtcttcccagtgttggtttgaaccctgtgagcctgagacagagagggccaggcaccaaccacaaggcgggaaagtccatgggtagaccctccccctggagggaagcatttctagtttttgctccttgactgtccagagtgtacaaatgttcataacgccattgaagggattatttcttgcatgcatatgctgaatttttttaagcaaatggatcatggcaccccaaaatgaaagttatagaaagctgtctacaactgtggagttggtagctggtaacattgttgtctcaagaacaactcacctctctccctaggactaatttttgtctctctcagttgaacatgttttgtcattcaagatcagtcaggtgcattctggcaactgacatacttgatggaggattgattcggtagagagcagtagaaatcttgttctaactgtgcctggtgagagactttggccccctccctccctataaggctgtggaacctgaggaagtagatacttgaagagattctgtttaggaagaaactcactctcttttgccagttgaatttatagagcattttttttcttaccaagatggccagtatcattttacccccacctcccaagccccaagaggtgtaccttttcagatgccattttacaggcggaaatgctccatgaaacaggaagccacttgcaagcaacatctgctctgttcctcaggtggggcccagagcccttccccgagactgctgatgtctgtaaccactggggagcactgccaaaaatacagctttctggtttgtgagcccataaatgacttaaatcagctttacatcatttttacatatcaagtggtttcatgttaaaaaacaaactcctagtcctttagaaataacagattctctgcacaaaaccacccattcattcatttattcattcacagcactagcaagtgctgcctatgctgagaacaagtcagatctgatccctgccctcatggacctgaccactcaacaaacagtccccaccacacctatctccttaggcaagactttgcctctctcctagtcctgagtataaatcctgtgcatagattcctctagaaaggcatcaaaaggctcaacagactgaatggcctcttggtctgcgaaaattcagttgcaatgaggatgaagtcactatcctagaggctgcttggcccagaagagccaggcacagagctgcagttgggcacgccaaggattccaaaggtggaatgagagagtagggtcaaactgtcacagtatctgctccataggtttctgtttttaatttcaatgttaaatacaactacaatatgagcgagaactgcattttcttgggtgttgagaacttgtaccatggacttcagaccgccttgcagccgtatgctgcacaagcgtgtacaccccctgggcagcctcaaaaccccgcttacagcagcaacacaggagatcatctgtccattttagaaccattaatctctttatccattgctgaacgactgtgactattcagtaacgaagtaatagtaattaattagtatggtataatctttaataaatttcgtgccaaaatgcatggttttccacttagcattcaaaatgttgcatagagagtagttttcaatttcttatgtactcttcgaagtaagttgaaaatcagtttctacattttaattcgtttcctgttaaatctgttgcactctcctgggctgtctttttctccagcagacccctgcatgcagttgtgtaaggactttctctaattcttgtgaatcgtctcacccgcagtaaccactgaacgtcaatcagccctccatggggttctttcgatttttggtgaagtattttgttacctcagtcttgtatcaagttgctgtatttttcagcttgttacattgataataattatttcactaattaaatactttaatgtacaaacatctttgtttactttgaaattaaatgtgttttccaatga

SEQ ID NO: 358932 - DNA, 5005 bp, Homo sapiens
aaatgttagcaatacctgtgatttttatctccaagaggaatcacatattgttacagacatttcaaaatgtcacttatgctcatctcttttacagtgcagtatcggaccgtactagatctgtttttagtgctttaatatagaagcacctatagaattatactgctggtttgttttttagttgtttaataactgtatttgagtattatcgatttcctttgtattttatacatttggaaacattattctgaggattgtccacaggcttaaccagacagccaaaggcaccatggccccaaaatggttacaagccatggtccaaagagaccactggagggagccctggaggctgctttctctgcatgttccagctcacctggggccgaccttcccactttagttacccgtgtttacatttctctttatgccagtcaccagctgaccctcctacgtggccctcttcttaactcatggtttctctacccatcaggcaatgtttacaagtttcagactggttcccgatttcatgcaatactgtggcacaagcatttggatgatgcatgtaaaagcaacaggcctcaggtacctgcaaaccttatgtcatttgagtaagtctctgcaggacgtggcatgacttcagaggcttctgggaacccaggctgggcctggtggtgaagagcagtcctgggcacaggctgtgagccagggtgctgggaaactcacagctggactcaggggacacggcctgtggcctcaccatcccagagggcttcaccagtgtgggatccacctgtcagtccccagcgactctcatgacactcattctgcagcaccgcctcttggggcagtggtcagaccccacacgccctctctgggcccaccacctgcatctgcgactagagagcacccggcccacgttgggttctcagtgctttctactgcacagagtggacagcgctaactaacctgtgagaggggcccgagagaaggaacagctgtggaacaggctttttacaccccaagtgcatggggttgctcgcccacagggctgcctcagattttgtacaaccccgaagcgtcctctgcgtgtgcgtgctgtacgtgtgtgtgtgtgtgtgagcgagtgtgaactcttcaagaaacatgcattttggcacaagactcgtgacatcacacacttcattcgctttgaggccctgctttaaccttaagttatagccctgtccaccgaggaaggtcagggtgagagcctagattcctcctgtgtcaagggtccctcgcattcttttactgtaaacaaacaatgccttaaattgtgtcttgttttctgttcctatgggtgctattcatctggaaggcctgcttccaggcctctttgctgtcagcccttctgagacaggacctggcttcaggactgtggactgggctgctggcctgcttgcttcctcccttccccattcctagcagggcctgaggccctcctcttctcgcccttcccaccatgccagaatgggaagttgtgacgttgcagctccaaccgacgtgctcatagtgatcagctgtgcaggagccatgaggcaccaacctctccccgcagggcaaagcctgtgcccccatcatctcactcctttgcctgcactgccagggtggggcccaccaagattcctgatcatgacgggaagctgagtgaccctgaggccttaagcttccccagtcttggccccaaatgcagtcaccagcaagttttccattttccaagtccaagggcacaattgttgatgaccgtgtgacaatagagcgaagccccggggagtgaacggtccaacctctgcattcagttaggagctcttcacatgaatcacatccttatctgtcaccttgtgtcacattttaaagtgacttttattttgcacaaataatttttattcagaataataaatcactctttatcatagtatcttctcttccctcttcccctttagtttggatagcctaactctgagaagttaacccttaaacagttttctggaagagactgaatttctgggtccttgcagctgtgatggtttcagagctcagactgatcaggcatcaagctaccctcaagagtttctgggctggatgtttcagaacaacatctacaccagtaaagtgtaataggtcagtttcaaaacgaccaaaagacccaccactgtattttgaccaaataatgacaacttctttagaaatttgaatggcttggtgaggaaagtagttgtcaccagggcctcattttgtagttgagccttacaatgcttagtagttcatcttctttttgagcaaagactagaatactttcctcctaagagaaactcccaggtgataaaagttgatgccatcaaaccttgacaccgggtgctctgcacacccacgcggatgttgcacctcattctcccgatgactattcaaatcagcatctagaggctgaatgacaatgccaaacactccacctctgatcagaaccatgcagtgttaacactttaacctacattgaatctgattctacctgttaacttttaaaaagtcgtaagtttggatgaaagtgcaagatgtggaacatcaactacctattttccttgggtttttccactctgcaaactgtcctggtttttcacaccaatgaagtattatagatgccaatccaaaacctcagaatttcaggcaccacaaaaacaggtaattttctatcccttataagtttgtcttttctttcagaaacatctcttagcctaatttgaaatagcacaatcacaattcaaaatgtttagtcttctcactaattgagtctgcttccacgtcctctcccaggaacattcttagctcggactcttgaagaatctctttagattttgttggcaaaagccttatagaagcagtaagaggcttgaccacgccggaagagtcctggagctaaagctggaagacactcagctctctaagcaggggctcggccaaacatgggagttaagtgctgcttgtcttcccagtgttggtttgaaccctgtgagcctgagacagagagggccaggcaccaaccacaaggcgggaaagtccatgggtagaccctccccctggagggaagcatttctagtttttgctccttgactgtccagagtgtacaaatgttcataacgccattgaagggattatttcttgcatgcatatgctgaatttttttaagcaaatggatcatggcaccccaaaatgaaagttatagaaagctgtctacaactgtggagttggtagctggtaacattgttgtctcaagaacaactcacctctctccctaggactaatttttgtctctctcagttgaacatgttttgtcattcaagatcagtcaggtgcattctggcaactgacatacttgatggaggattgattcggtagagagcagtagaaatcttgttctaactgtgcctggtgagagactttggccccctccctccctataaggctgtggaacctgaggaagtagatacttgaagagattctgtttaggaagaaactcactctcttttgccagttgaatttatagagcattttttttcttaccaagatggccagtatcattttacccccacctcccaagccccaagaggtgtaccttttcagatgccattttacaggcggaaatgctccatgaaacaggaagccacttgcaagcaacatctgctctgttcctcaggtggggcccagagcccttccccgagactgctgatgtctgtaaccactggggagcactgccaaaaatacagctttctggtttgtgagcccataaatgacttaaatcagctttacatcatttttacatatcaagtggtttcatgttaaaaaacaaactcctagtcctttagaaataacagattctctgcacaaaaccacccattcattcatttattcattcacagcactagcaagtgctgcctatgctgagaacaagtcagatctgatccctgccctcatggacctgaccactcaacaaacagtccccaccacacctatctccttaggcaagactttgcctctctcctagtcctgagtataaatcctgtgcatagattcctctagaaaggcatcaaaaggctcaacagactgaatggcctcttggtctgcgaaaattcagttgcaatgaggatgaagtcactatcctagaggctgcttggcccagaagagccaggcacagagctgcagttgggcacgccaaggattccaaaggtggaatgagagagtagggtcaaactgtcacagtatctgctccataggtttctgtttttaatttcaatgttaaatacaactacaatatgagcgagaactgcattttcttgggtgttgagaacttgtaccatggacttcagaccgccttgcagccgtatgctgcacaagcgtgtacaccccctgggcagcctcaaaaccccgcttacagcagcaacacaggagatcatctgtccattttagaaccattaatctctttatccattgctgaacgactgtgactattcagtaacgaagtaatagtaattaattagtatggtataatctttaataaatttcgtgccaaaatgcatggttttccacttagcattcaaaatgttgcatagagagtagttttcaatttcttatgtactcttcgaagtaagttgaaaatcagtttctacattttaattcgtttcctgttaaatctgttgcactctcctgggctgtctttttctccagcagacccctgcatgcagttgtgtaaggactttctctaattcttgtgaatcgtctcacccgcagtaaccactgaacgtcaatcagccctccatggggttctttcgatttttggtgaagtattttgttacctcagtcttgtatcaagttgctgtatttttcagcttgttacattgataataattatttcactaattaaatactttaatgtacaaacatctttgtttactttgaaattaaatgtgttttccaatga

SEQ ID NO: 358933 - DNA, 2251 bp, Homo sapiens
cgccgctcaggccctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcaggtccctctgctggctccggttctgcgaggttcagccggaggcccacctgtcctgacacatctgttgctggcagcctccccacacctccagtccccagacacaggaagagccacagcctaggcaacaacaggggacgtctctatgccaccctggggcccaactggcgggttccagttaggaattctcccagaacccggagctgtgtctacagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacacgtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggaagccggagcagctccaggtccaacaggaactgacagccacgaggtggaccacctggagggcggtgcggggaaggaggcagggccctgtgcctgaagcctgggcaccatggtggccccagtcaggagcaacagtggtagccctgagtaaaacccattgtccctctttggaggagcggccagaggatgacagcagccccagcaggcagcagtgcctgggcaggctgatccagcagagcactaatgggtcagtttcatgtattggcagatgtggtgtagcatggcaaggctacaagttttaaggatttttgtctgattttcagacctggaggaggggatttttcttcctactttcccccttttttatttctaatttactttcaaccaaatattcccactatgtgctatatgtaataataaaaagttgacaacaactgaaaaatcaacagcagag

SEQ ID NO: 358934 - DNA, 822 bp, Homo sapiens
cgccgctcaggccctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggagtgaagcatggaggtggggacagacttcaagcgatggagatataaacaacctaggtcagtcatacgcagtgtcatcatctgttcagtcttcctacttgtcctgggctgaccttgccctctggttcttagcttcctgccttggctccaacctcactccagcccttattgatggggcttcatggtttgtctttggttctcctaccttgaccccaccttttcaagaagtacaccttatatttcaatgtcacgtctttttacatcagttagagctgtgttgtcttaatatggtggctgcatgtg

SEQ ID NO: 358935 - DNA, 6374 bp, Homo sapiens
cgccgctcaggccctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcaggtccctctgctggctccggttctgcgaggttcagccggaggcccacctgtcctgacacatctgttgctggcagcctccccacacctccagtccccagacacaggaagagccacagcctaggcaacaatatgatgtgtcagttgagtgtagttgagagtaaaagtgcgacattcccatcggagaaagcaaggcacctactggacgacagtgtcctagagtcccgcagcccccgaaggggcctggctctgacctcctcctctgctgtcaccaatggactctccctaggcagtagtgagagctcagagtttagtgaagagatgtcttcagggctggaaagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacactataaatccacacctggcaaaaaggtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggtacctgcaaaccttatgtcatttgagtaagtctctgcaggacgtggcatgacttcagaggcttctgggaacccaggctgggcctggtggtgaagagcagtcctgggcacaggctgtgagccagggtgctgggaaactcacagctggactcaggggacacggcctgtggcctcaccatcccagagggcttcaccagtgtgggatccacctgtcagtccccagcgactctcatgacactcattctgcagcaccgcctcttggggcagtggtcagaccccacacgccctctctgggcccaccacctgcatctgcgactagagagcacccggcccacgttgggttctcagtgctttctactgcacagagtggacagcgctaactaacctgtgagaggggcccgagagaaggaacagctgtggaacaggctttttacaccccaagtgcatggggttgctcgcccacagggctgcctcagattttgtacaaccccgaagcgtcctctgcgtgtgcgtgctgtacgtgtgtgtgtgtgtgtgagcgagtgtgaactcttcaagaaacatgcattttggcacaagactcgtgacatcacacacttcattcgctttgaggccctgctttaaccttaagttatagccctgtccaccgaggaaggtcagggtgagagcctagattcctcctgtgtcaagggtccctcgcattcttttactgtaaacaaacaatgccttaaattgtgtcttgttttctgttcctatgggtgctattcatctggaaggcctgcttccaggcctctttgctgtcagcccttctgagacaggacctggcttcaggactgtggactgggctgctggcctgcttgcttcctcccttccccattcctagcagggcctgaggccctcctcttctcgcccttcccaccatgccagaatgggaagttgtgacgttgcagctccaaccgacgtgctcatagtgatcagctgtgcaggagccatgaggcaccaacctctccccgcagggcaaagcctgtgcccccatcatctcactcctttgcctgcactgccagggtggggcccaccaagattcctgatcatgacgggaagctgagtgaccctgaggccttaagcttccccagtcttggccccaaatgcagtcaccagcaagttttccattttccaagtccaagggcacaattgttgatgaccgtgtgacaatagagcgaagccccggggagtgaacggtccaacctctgcattcagttaggagctcttcacatgaatcacatccttatctgtcaccttgtgtcacattttaaagtgacttttattttgcacaaataatttttattcagaataataaatcactctttatcatagtatcttctcttccctcttcccctttagtttggatagcctaactctgagaagttaacccttaaacagttttctggaagagactgaatttctgggtccttgcagctgtgatggtttcagagctcagactgatcaggcatcaagctaccctcaagagtttctgggctggatgtttcagaacaacatctacaccagtaaagtgtaataggtcagtttcaaaacgaccaaaagacccaccactgtattttgaccaaataatgacaacttctttagaaatttgaatggcttggtgaggaaagtagttgtcaccagggcctcattttgtagttgagccttacaatgcttagtagttcatcttctttttgagcaaagactagaatactttcctcctaagagaaactcccaggtgataaaagttgatgccatcaaaccttgacaccgggtgctctgcacacccacgcggatgttgcacctcattctcccgatgactattcaaatcagcatctagaggctgaatgacaatgccaaacactccacctctgatcagaaccatgcagtgttaacactttaacctacattgaatctgattctacctgttaacttttaaaaagtcgtaagtttggatgaaagtgcaagatgtggaacatcaactacctattttccttgggtttttccactctgcaaactgtcctggtttttcacaccaatgaagtattatagatgccaatccaaaacctcagaatttcaggcaccacaaaaacaggtaattttctatcccttataagtttgtcttttctttcagaaacatctcttagcctaatttgaaatagcacaatcacaattcaaaatgtttagtcttctcactaattgagtctgcttccacgtcctctcccaggaacattcttagctcggactcttgaagaatctctttagattttgttggcaaaagccttatagaagcagtaagaggcttgaccacgccggaagagtcctggagctaaagctggaagacactcagctctctaagcaggggctcggccaaacatgggagttaagtgctgcttgtcttcccagtgttggtttgaaccctgtgagcctgagacagagagggccaggcaccaaccacaaggcgggaaagtccatgggtagaccctccccctggagggaagcatttctagtttttgctccttgactgtccagagtgtacaaatgttcataacgccattgaagggattatttcttgcatgcatatgctgaatttttttaagcaaatggatcatggcaccccaaaatgaaagttatagaaagctgtctacaactgtggagttggtagctggtaacattgttgtctcaagaacaactcacctctctccctaggactaatttttgtctctctcagttgaacatgttttgtcattcaagatcagtcaggtgcattctggcaactgacatacttgatggaggattgattcggtagagagcagtagaaatcttgttctaactgtgcctggtgagagactttggccccctccctccctataaggctgtggaacctgaggaagtagatacttgaagagattctgtttaggaagaaactcactctcttttgccagttgaatttatagagcattttttttcttaccaagatggccagtatcattttacccccacctcccaagccccaagaggtgtaccttttcagatgccattttacaggcggaaatgctccatgaaacaggaagccacttgcaagcaacatctgctctgttcctcaggtggggcccagagcccttccccgagactgctgatgtctgtaaccactggggagcactgccaaaaatacagctttctggtttgtgagcccataaatgacttaaatcagctttacatcatttttacatatcaagtggtttcatgttaaaaaacaaactcctagtcctttagaaataacagattctctgcacaaaaccacccattcattcatttattcattcacagcactagcaagtgctgcctatgctgagaacaagtcagatctgatccctgccctcatggacctgaccactcaacaaacagtccccaccacacctatctccttaggcaagactttgcctctctcctagtcctgagtataaatcctgtgcatagattcctctagaaaggcatcaaaaggctcaacagactgaatggcctcttggtctgcgaaaattcagttgcaatgaggatgaagtcactatcctagaggctgcttggcccagaagagccaggcacagagctgcagttgggcacgccaaggattccaaaggtggaatgagagagtagggtcaaactgtcacagtatctgctccataggtttctgtttttaatttcaatgttaaatacaactacaatatgagcgagaactgcattttcttgggtgttgagaacttgtaccatggacttcagaccgccttgcagccgtatgctgcacaagcgtgtacaccccctgggcagcctcaaaaccccgcttacagcagcaacacaggagatcatctgtccattttagaaccattaatctctttatccattgctgaacgactgtgactattcagtaacgaagtaatagtaattaattagtatggtataatctttaataaatttcgtgccaaaatgcatggttttccacttagcattcaaaatgttgcatagagagtagttttcaatttcttatgtactcttcgaagtaagttgaaaatcagtttctacattttaattcgtttcctgttaaatctgttgcactctcctgggctgtctttttctccagcagacccctgcatgcagttgtgtaaggactttctctaattcttgtgaatcgtctcacccgcagtaaccactgaacgtcaatcagccctccatggggttctttcgatttttggtgaagtattttgttacctcagtcttgtatcaagttgctgtatttttcagcttgttacattgataataattatttcactaattaaatactttaatgtacaaacatctttgtttactttgaaattaaatgtgttttccaatga

SEQ ID NO: 358936 - DNA, 4930 bp, Homo sapiens
gtttactggcctggcagctccagcaggggacgtctctatgccaccctggggcccaactggcgggttccagttaggaattctcccagaacccggagctgtgtctacagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacactataaatccacacctggcaaaaaggtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggtacctgcaaaccttatgtcatttgagtaagtctctgcaggacgtggcatgacttcagaggcttctgggaacccaggctgggcctggtggtgaagagcagtcctgggcacaggctgtgagccagggtgctgggaaactcacagctggactcaggggacacggcctgtggcctcaccatcccagagggcttcaccagtgtgggatccacctgtcagtccccagcgactctcatgacactcattctgcagcaccgcctcttggggcagtggtcagaccccacacgccctctctgggcccaccacctgcatctgcgactagagagcacccggcccacgttgggttctcagtgctttctactgcacagagtggacagcgctaactaacctgtgagaggggcccgagagaaggaacagctgtggaacaggctttttacaccccaagtgcatggggttgctcgcccacagggctgcctcagattttgtacaaccccgaagcgtcctctgcgtgtgcgtgctgtacgtgtgtgtgtgtgtgtgagcgagtgtgaactcttcaagaaacatgcattttggcacaagactcgtgacatcacacacttcattcgctttgaggccctgctttaaccttaagttatagccctgtccaccgaggaaggtcagggtgagagcctagattcctcctgtgtcaagggtccctcgcattcttttactgtaaacaaacaatgccttaaattgtgtcttgttttctgttcctatgggtgctattcatctggaaggcctgcttccaggcctctttgctgtcagcccttctgagacaggacctggcttcaggactgtggactgggctgctggcctgcttgcttcctcccttccccattcctagcagggcctgaggccctcctcttctcgcccttcccaccatgccagaatgggaagttgtgacgttgcagctccaaccgacgtgctcatagtgatcagctgtgcaggagccatgaggcaccaacctctccccgcagggcaaagcctgtgcccccatcatctcactcctttgcctgcactgccagggtggggcccaccaagattcctgatcatgacgggaagctgagtgaccctgaggccttaagcttccccagtcttggccccaaatgcagtcaccagcaagttttccattttccaagtccaagggcacaattgttgatgaccgtgtgacaatagagcgaagccccggggagtgaacggtccaacctctgcattcagttaggagctcttcacatgaatcacatccttatctgtcaccttgtgtcacattttaaagtgacttttattttgcacaaataatttttattcagaataataaatcactctttatcatagtatcttctcttccctcttcccctttagtttggatagcctaactctgagaagttaacccttaaacagttttctggaagagactgaatttctgggtccttgcagctgtgatggtttcagagctcagactgatcaggcatcaagctaccctcaagagtttctgggctggatgtttcagaacaacatctacaccagtaaagtgtaataggtcagtttcaaaacgaccaaaagacccaccactgtattttgaccaaataatgacaacttctttagaaatttgaatggcttggtgaggaaagtagttgtcaccagggcctcattttgtagttgagccttacaatgcttagtagttcatcttctttttgagcaaagactagaatactttcctcctaagagaaactcccaggtgataaaagttgatgccatcaaaccttgacaccgggtgctctgcacacccacgcggatgttgcacctcattctcccgatgactattcaaatcagcatctagaggctgaatgacaatgccaaacactccacctctgatcagaaccatgcagtgttaacactttaacctacattgaatctgattctacctgttaacttttaaaaagtcgtaagtttggatgaaagtgcaagatgtggaacatcaactacctattttccttgggtttttccactctgcaaactgtcctggtttttcacaccaatgaagtattatagatgccaatccaaaacctcagaatttcaggcaccacaaaaacaggtaattttctatcccttataagtttgtcttttctttcagaaacatctcttagcctaatttgaaatagcacaatcacaattcaaaatgtttagtcttctcactaattgagtctgcttccacgtcctctcccaggaacattcttagctcggactcttgaagaatctctttagattttgttggcaaaagccttatagaagcagtaagaggcttgaccacgccggaagagtcctggagctaaagctggaagacactcagctctctaagcaggggctcggccaaacatgggagttaagtgctgcttgtcttcccagtgttggtttgaaccctgtgagcctgagacagagagggccaggcaccaaccacaaggcgggaaagtccatgggtagaccctccccctggagggaagcatttctagtttttgctccttgactgtccagagtgtacaaatgttcataacgccattgaagggattatttcttgcatgcatatgctgaatttttttaagcaaatggatcatggcaccccaaaatgaaagttatagaaagctgtctacaactgtggagttggtagctggtaacattgttgtctcaagaacaactcacctctctccctaggactaatttttgtctctctcagttgaacatgttttgtcattcaagatcagtcaggtgcattctggcaactgacatacttgatggaggattgattcggtagagagcagtagaaatcttgttctaactgtgcctggtgagagactttggccccctccctccctataaggctgtggaacctgaggaagtagatacttgaagagattctgtttaggaagaaactcactctcttttgccagttgaatttatagagcattttttttcttaccaagatggccagtatcattttacccccacctcccaagccccaagaggtgtaccttttcagatgccattttacaggcggaaatgctccatgaaacaggaagccacttgcaagcaacatctgctctgttcctcaggtggggcccagagcccttccccgagactgctgatgtctgtaaccactggggagcactgccaaaaatacagctttctggtttgtgagcccataaatgacttaaatcagctttacatcatttttacatatcaagtggtttcatgttaaaaaacaaactcctagtcctttagaaataacagattctctgcacaaaaccacccattcattcatttattcattcacagcactagcaagtgctgcctatgctgagaacaagtcagatctgatccctgccctcatggacctgaccactcaacaaacagtccccaccacacctatctccttaggcaagactttgcctctctcctagtcctgagtataaatcctgtgcatagattcctctagaaaggcatcaaaaggctcaacagactgaatggcctcttggtctgcgaaaattcagttgcaatgaggatgaagtcactatcctagaggctgcttggcccagaagagccaggcacagagctgcagttgggcacgccaaggattccaaaggtggaatgagagagtagggtcaaactgtcacagtatctgctccataggtttctgtttttaatttcaatgttaaatacaactacaatatgagcgagaactgcattttcttgggtgttgagaacttgtaccatggacttcagaccgccttgcagccgtatgctgcacaagcgtgtacaccccctgggcagcctcaaaaccccgcttacagcagcaacacaggagatcatctgtccattttagaaccattaatctctttatccattgctgaacgactgtgactattcagtaacgaagtaatagtaattaattagtatggtataatctttaataaatttcgtgccaaaatgcatggttttccacttagcattcaaaatgttgcatagagagtagttttcaatttcttatgtactcttcgaagtaagttgaaaatcagtttctacattttaattcgtttcctgttaaatctgttgcactctcctgggctgtctttttctccagcagacccctgcatgcagttgtgtaaggactttctctaattcttgtgaatcgtctcacccgcagtaaccactgaacgtcaatcagccctccatggggttctttcgatttttggtgaagtattttgttacctcagtcttgtatcaagttgctgtatttttcagcttgttacattgataataattatttcactaattaaatactttaatgtacaaacatctttgtttactttgaaattaaatgtgttttccaatga

SEQ ID NO: 358937 - DNA, 1173 bp, Homo sapiens
cgccgctcaggccctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatccagctgctctgtgtttggcagtcgtgtgaagaggcccgtgtggcacgggattgagacctgccaacaaccatgtgagggagtttggaagaagattctgctaaaaaggcgagccttcagatgagactgcagccccagccaatagcttgactgaagtctcatcacagaccttaaaccagagacacccagctaagacatgcccaaattcccaatccacagaaactgcaagacaataaatgtttattgtaagatgctaa

SEQ ID NO: 358938 - DNA, 1369 bp, Homo sapiens
accgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctggccctggttcccagacatcatctctgaacctgctgggggaatttgccaccctgaaaggaaggacacaagcccagctggcttcatcatctgctgattgtggagctctagggccttgagcaaacatatgtggtagccaggtagtggttacagcaggccttggtaagacccagtgctgtattggcttcaggtctaacccagcacagttctaatggtggtgccacagtggtacatgcctatagtcccagctactccagaagctgaggtgggaagatcacttgagcctgggagattgaggctgcagtgagctgagatcatgccattgcactccagcttgggcaccagagcaagaccttgtctc

SEQ ID NO: 358939 - DNA, 327 bp, Homo sapiens
aagcaagaggtaaagatgttcagttgatgtagcctattacttttagaaactgattgttacattccttcaaaacattttcaaattatgtaagaaaaacgatagaattctatctttttgttacttgggcagaacaaatcaaaagaggtggtgatgcagggatgcctggaatagaagagaatgacctagcaaaagttgatgatcttccccctgggtaagtaaaaattgttagagaattcgactaaagtgatgataatacatttcatgtgaccccattctctttttcggtaacacttggaatagtgctacagatatctggatgatcgatat

SEQ ID NO: 358940 - DNA, 3906 bp, Homo sapiens
accgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaagagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaacttg

SEQ ID NO: 358941 - DNA, 3069 bp, Homo sapiens
aagcaagaggtaaagatgttcagttgatgtagcctattacttttagaaactgattgttacattccttcaaaacattttcaaattatgtaagaaaaacgatagaattctatctttttgttacttgggcagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaacttg

SEQ ID NO: 358942 - DNA, 4246 bp, Homo sapiens
accgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaacttgaaaaaaaaaggagagaaagaagagaaagcagagaaaaaagagagagaaggggaaaaaaaagaagaaaaaaagtgggcgcggaggctaccacacaaaagaagagtgcaaagcaccaagcgaggagagaggggcgccaaggaggcaacaaagggcgacaagagatacaagaaagcgacggaacacacagcgggaggcaaccacaaaaaaagcggcggaacacaggggcgaaacaaccacggcggacgaaggacacagaggaaccacgaggggccgagggagagacgg

SEQ ID NO: 358943 - DNA, 4049 bp, Homo sapiens
  misc_feature (4039)..(4039): n is a, c, g, or t
accgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaacttgaaaaccaaagaaaaaaaaaactcggctcgaaagaattcatacagcccggggaatccactaggtctagatcgccaaacnccgcggagag

SEQ ID NO: 358944 - DNA, 2792 bp, Homo sapiens
accgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactctgtatgggggatctccgagatcccccatacagagtagcaaatgaagaagccagtgtgtgaccctccagcatctccgcaagggctgcttcaggatgaagccgctgaagaaagaaagaaagaaaggtgtgtgggaaaaagagcagggacctcgggaaagctcctccattctaactgtctgaagaggatactttcattttgaacatggccgagtacctcatggtatttcttgtatgaatggcctttaactcataatgtcgattattatcctgttgttttaacactctgatggggtctcgcggga

SEQ ID NO: 358945 - DNA, 1376 bp, Homo sapiens
accgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgcatccaggaaaagcttttaggttttgtgtgtgtgtgtgtgtgtgtgtgacagagtctcgctctgttgtccaggctgaagtatagtagcgtgatcttggctcactgcaacctgcgcctcctgggttcaagcaattcttctgtctcagcctcccaagtagctgagattacaggcgcctgccaccatgcctggctaattttttgtatttttagtagagatggggtttcaccatgttggccaggctggtcttgaactcctgacctcaggtgatccacc

SEQ ID NO: 358946 - DNA, 553 bp, Homo sapiens
cccatatctactaaaaatacaaaaattagccggatgtggtgttgcacacctgtagtctcagctgtctgggaggttgaggtgagagaatcacttgagctcaggaggtgcaggttgcagtgagccaagattgcaccactgcactctaacctgagtgacagagcaagaccctatctcaaataaataaatgaataaattttattgaccatgaatgtgttacaaaaggatattaaatgtggtgtttgttatataatttaatttcctgggagtattactaaagaaattgagaattatgtataattaaaaaaacatcccatagcttctgaataggaagcattacaatgagtgaacttgattcctttggttcttaccttgggtggatagagcaacttgctgagcttcgtcaggaatttcttcgacaagaagaccagcttcaggactataggaagaacaatacttaccttgtgaagaggttagaatatgaaaggtaagatgttacatgcaacatatgtttatgaatctaaaatatttgtccagcttttggactcagttcatt

SEQ ID NO: 358947 - DNA, 3961 bp, Homo sapiens
accgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaacttg

SEQ ID NO: 358948 - DNA, 3793 bp, Homo sapiens
accgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaaatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaacttg

SEQ ID NO: 358949 - DNA, 3907 bp, Homo sapiens
accgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaacttg

SEQ ID NO: 358950 - DNA, 4396 bp, Homo sapiens
accgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaacttgaaaaaaaaaaaaaaaaaaaaaaaaaaaaaaaaaaaaaaaaaaaaaagaaaaacaaaaaaaaaaaaatcaacaataaaacaaaatgaatcaaaaagaagaggatcaagaaagacaagaggagcaaacaggataaagaacatagcacaaaaaaacacagcatacgaaaagcccacacgcaagaagacgacacagggcggggcgctcgacgctcctcgcagcccggcagaatcgagaaacgacacgcgctaccgcgagagcaggagagcgaactgccgagcgaccccaggcggaggggcaatataccaagtcagagcagcgaataccagaaacatcaaaatctcgccgctgaacgaaaacagccgctggcgagtgcgagaagacaacagaagatagagaggaacagaagcagacgccaccaacctgcgaccacgcaca

SEQ ID NO: 358951 - DNA, 2884 bp, Homo sapiens
accgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaagatgatgaagaacgagagcttcaaatggatcctgcagactatggaaagcaacatttcaatgatgtcctttaagtcctaaaggaatgcttcagaaaacctaaaagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaacttg

SEQ ID NO: 358952 - DNA, 1155 bp, Homo sapiens
accgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgtgctttaaggacctcctatttcagtttctcatcttgggagggatcctcgtcac

SEQ ID NO: 358953 - DNA, 324 bp, Homo sapiens
ggtttgagaaccaacaatggattcattgcaactgtccattctcatagcttatagagtcactttattttataaagaaattctaaacagcattagagctctgcttccttctttctcccttgtgattcattcaaagatgcaatggcttggttcaggaattgacaaaagggccacagtgttaccaattgttagtgagtgttaccaccccctttagttttttttgtaactatttaatctcattgtagatattttaaaagatttgatgattattgtgcataactcatgttggcaaactattataactctgaacttatcctgtttggttgt

SEQ ID NO: 358954 - DNA, 427 bp, Homo sapiens
ttggcctcccaaagtgctaggattacaggtgtgagtcaccgcgcccggccagaaaatatcacattttctgttgtgatactgaaaatcacaaattgtgggtgcactgggtatagtaagggcattgtttcataaaacttttgtgtctattttatgtacatgtgtgttgcaaactcggtcatgatataaaatatattttcttaccatgggtgatagtcaacaaaggttgaaaaacattgctttaatacctgcttttctcttttctgttttgcctcaaaacttcttgatacgctacttctatagaagcttggaaccaaaaaagttaatgatgataaaattgataataatgatatcaagagtaatatttactgaatatatactacgtaccaggaactgtgctgttttactttaatgatctcacttaatctgt

SEQ ID NO: 358955 - DNA, 360 bp, Homo sapiens
ggagaggagagagcactttcctctgctcctgcacttggctttgacgtgtaaagagacactttgctctagggatttaaagacttgagctatctatagaatgtgatttagagaggataccaaattatttaaaataatggtcatcctctcaagttagaaaactatagaatctaataaagttgagaacatttgcttacataaacatttaaaaattgatggttagtttcatgcatatgatacatctaagttttattagtagccagctggtaatagtttttacaacttttaaagttagctaagtacagccatacaccacataccattttggtcaacagtggtctgcatatatgcctgtatgatggt

SEQ ID NO: 358956 - DNA, 1414 bp, Homo sapiens
ttcatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcttgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcatcgtggcaacgttgctggtgacagcaaaaatgacccaccaatggaagcagctggcttcactgctcaggtgattatcctgaaccatccgggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgctgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaagaaatgaacaag

SEQ ID NO: 358957 - DNA, 1995 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaaatgccaggcaggctgggcccccaaaggctcctttttcaaaacctctggaagccgcggttgaatgtgccatgaccctctccctctctggatggcaccatcattgaagctggcgtcatcggagtctcttgttctgttggcgtgctacctggaagatccttctgtcctggacaagaggaattggaagagcattttatgttttaagaacaggctgacacgcagcagctacaacaacagctgagatcacttaataaatggtgctaaacta

SEQ ID NO: 358958 - DNA, 1970 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaaatgccaggcaggctggccccaaggtctttcaaactctggaagcgggtgatgtgcatgaccttcctttggatggacatcatgaactgggtcatcggagcctgtctgtgggtgcaccggaacctctgtccgcaagatggagacctttgtttaaaagtggacgcgggtcacacagtggacattagggctcaaaaaaaaccggctttgggaagaaaaggcagatctgcctttaggtcccttgtt

SEQ ID NO: 358959 - DNA, 2171 bp, Homo sapiens
  misc_feature (848)..(848): n is a, c, g, or t
  misc_feature (868)..(868): n is a, c, g, or t
  misc_feature (917)..(917): n is a, c, g, or t
  misc_feature (1210)..(1210): n is a, c, g, or t
  misc_feature (1293)..(1293): n is a, c, g, or t
  misc_feature (1305)..(1305): n is a, c, g, or t
  misc_feature (1338)..(1338): n is a, c, g, or t
  misc_feature (1511)..(1511): n is a, c, g, or t
  misc_feature (1581)..(1581): n is a, c, g, or t
  misc_feature (1645)..(1645): n is a, c, g, or t
atgaatgaatgaatgatagtctcgagctgtttaacttcatctctcttatggtttgcatataagattgtgcagtggggctgggcgcggtggctcacgcctgtaatcacaacactttggaaggccaaggcaggtggatcacctgaggtcaggagttcgagaccagcctggctaacatggtgaatggtgaaaccccatctactaaaaatacaaaaattagccaggcgtggtggtgtgtgcctgtagtcccagctactcgggaggctgaggcaggagaatcacttgaacccagaaggcagaggttgcagtgagctgaggcaggctgcaccattgcactccagcctggacaaaaagagcgaaactccatctcaaaaaaacaaacaaaaaaaagattgtgcagtgtagttgtaagattggggagaccaaactgttaaagcgattattgactggggaactggagatggttgacatactttgtcctcaccaagcccctttcagttccttattcacaatgagccactagtgggtgtacttggttctagtgggtatatgtggttttattcaactatgttagggtggataaaggtttacattattgccgattgtattcatatgaccatttactattccgagtcactacatgcagctaagcttagcagttgctgagtataaagcactgccttgaagccctatagatggcgttagttctgacttctttttaccatgtaagacatcacgtgtgcttgtgctagagaggaactaaagggacagccatttcacgcagtgtaaggctgatttctccttaggtgctccccatatctagaagtatgacctgaatctttgtctactcnatacccattgtcagctccanagttgtggtatcttgctgtatgttgatttagagcctgctcagcagtttngcagataccagctatttctcattggaatgttccgtgttttctctttcctcctaaagtgtgcctcttcactggccagtacttactacgtatcctctgtgaataaggaaataatctttcctatcaagacactagtgaacctgtagtcccagctacttgggaggctgagatgggaggatcccttgacaccaggagttagaggctgtgatgagctatgatcatactgctgcgtagaccctgtctcttttttttttctttttttaaggggagggggggtgacactaatgagaaaaacnggactactgtgatgaatacaaataagcatatacttgatggaaaaatataaatctagttttctcacgggattgtgaaggagcgncaaggagaaacntaatttttctagctaagaagagggccttaaacnctagctatgagaagctaagtcctgtatgattttggattggcctggacttagcaacagcaccatgatgtagagtggtatgtgtggtacatgtggttgattctatcacttatgcttagtaactaaacaggtctaagaggtatttacatgtggttgattctatcacttatgcttantaactaaacaggtctaagaggtatttcattcagcaaatgctatatttgccagttaaacaatctttcatcngtaagtgatttggttctaaaaaatgcattcaggctgaggctgtgtgacacttacatacctcaangctaaagagtttccattgtgcaaaaacctggtcctcttactgcatgtgatgactaccctgcagcttgagtgggagagtgcgtattaacatggtttcaccaactaaagctcctggctgaggcttgcatttctcaccaaagattttattcttgaattgcgaatgttacattttttattttgtcaaactagatggtatgtttttcctctaatatgtcttccctcacaacaccacacatgaaaatgagtcctctgaaaaggacagcctgtagtatagtgtcttccatgcttatgttcttaactaaatctcaaccttgggatgcattcaaagaaaagtaaaagacacatgttttttactctggggtcttctctctgcaggtggagcagttctggaggttttatagccacatggtacgtcctggggacctgacaggccacagtgacttccatctcttcaaagaaggaattaaacccatgtgggaggtaaggactaatggcttctgactgcttttttgagcaagtttgggttt

SEQ ID NO: 358960 - DNA, 679 bp, Homo sapiens
cgctggggctggggcggcgcaaaccctgcggcaccggcttccctgctgggatccggctgcgggacctggcctggactggcggggaggagggggctggggagcaatggataccggagtcccggagaccccagggccgtccgaaccgagggcgaagagctgggcccgggggaggggtggctgtgccgcccggtagggggagattttcggacgccccgccctggtggatgcggattgcctgcgacgtggaggggtggggacctcggcggtttgggtgtttccgcagtctggcagcgctgcctctgaatccagctttccccacacactccctctcccctctgagcctcagttttctcatctgcagagtggggacggtaacaccctttgtcgtagagtttggaggatgcaatgagtgatcagcagcaaaaccactaaaaagaaaggaagtttgaaagatgatgacagtggggaccatgatcagaatgaagaaaacagcacacagaaagatggtgagaaggaaaaaacggaacgagacaagaatcagagcagtagcaagagaaaggtaagaagatgaggcacaaacaggttaagtaacttaacagtgatgaatctcatagaggaggcagtgcttggactgggcatatgctgagataagatacaaagatgaatacctattatatga

SEQ ID NO: 358961 - DNA, 2489 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaaatgccaggcaggctgggcccccaaaggctcctttttcaaaacctctggaagccgcggttgaatgtgccatgaccctctccctctctggatggcaccatcattgaagctggcgtcatcggagtctcttgttctgttggcgtgctacctggaagatccttctgtcctggacaagaggaattggaagagcattttatgttttaagaacaggctgacacgcagcagctacaacaacagctgagatcacttaataaatggtgctaaactaaaaaaaaaaaaaaaaaaaaaacaacaaacaaaaaaagaaaaacaacaacacaccggagagacatatattgtggggggccgacaaaaagcgcatataaaataggccatgtggacacacagatattctcctgaccccaaatctgtcgtgcacacaggggtgcaaacacccggggacccccataaaggagggggcccgtaataaaattcgacgaggaaaacgccccggtggtacaccccgcggttataaggacgcggcacgatgcacacatcggaccgacacgacacacgactacgagaggaagcgcacacaaacgcgtacgacaacaaaacagcgagaacagagcgcaaccaaccaaaaaggcgggccacacaccacagagcagaacaaaaaaacacaccacaaacgacggaaagatgcagaggaagagaggacacaaccgaaccagagacccgaagaagaaggacacaaaaaaactaataaaaacgcaagcaggc

SEQ ID NO: 358962 - DNA, 2058 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaaatgccaggcaggctgggcccccaaaggctcctttttcaaaacctctggaagccgcggttgaatgtgccatgaccctctccctctctggatggcaccatcattgaagctggcgtcatcggagtctcttgttctgttggcgtgctacctggaagatccttctgtcctggacaagaggaattggaagagcattttatgttttaagaacaggctgacacgcagcagctacaacaacagctgagatcacttaataaatggtgctaaactagagagaagcgtccgcactcccccgcaaggcacctatatcggcccgcccaacaccaatcaaacg

SEQ ID NO: 358963 - DNA, 3727 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaagtacgtgttggggggttatgggaggacgtgtccctaagcttagtataagtagatctgtagttgggcccagaggaatatggcggacaggagacttacttgtggagaaggacgaccagaccaggccttccctctagggcttctggctacttgctgcagttctttgtcagcgaggctccctgccacctatactaccaggtgctttgtagcagagagagcccatctgcagaaacccagttgtactacctgggcttgcttaatttctacaggctgtcttgtctttcatatgctaaccactatcttaaaatgaaagacaagtgcttttctttttcttgctgttttttaagataatttcaccctgcccaccctcaccccacttctgcatgtctttttaacttgttagcttcagtctattttctttgtcctgggatactgactacttatcaggaatgactccatttccttgtgtatagagctgactcttagaagaagggggatagtgtgtgtgtgagagagcagaatcaaagggaagcatgaaggccacagggaaaataagcttggcaatctccctaggactcagggaaatagagctctctgtccacagtgagaatcactgttaggcttgctcctcagtgattgagtgtcagaagtaagctcaggctattgtgaaaaagtgtggggagtggctgtcagattgtctcaaagctggagggtgagctagccagctaagagttaggactcttaggtttagttctctcatatggccccataccaatatgtgcctttgacaagtgtctttgcaactttgcttcagtttctccatctgtaaagtgggagacagtactttatctaacaaggctattgtgaggctgatttaatctttaactgagggtcttcagatggagaatgcttttacggggccaagtagtagtattgctatcatcatcatcatcattagtaagagtatcatcatgttgttattattgaaggctagtagtgagcccagcaattatgttcagcagacagaccatttgggaatctctttcccatgcattcatagataatgtggagtggagttggcttaaaccagctaagtgccagtttttaagtgggaacactgctatgggcgttggtccatgatcaaacggctggcatgactcatcatagtcacgaacagttattagccagccatggctgtggttgcttgccttagcagtcctgtgttagcattgctttactctgggcacatttttcttattctctattctgggatagaagtagtttctgacttctagccacgttcagtccaggctggagagatctacacctgtttctaggattctcgttttcaaggtttctgaatatcccctactcccacttacccccaaaataagctttttacctggataggagagggaaagaggtatttttcatcaattctccccttctctgctcttctccctttctaataccataaggcagttcttcgtgacttttacagaaacatatgtacacgtccttacagagtttaggagagcctgtgggctttttgccttagtctgctagaaagactggcctgctgctctctgctttatccagaggtctgcctctgggacttcagccctgtagctgtagagaccagaagaccaaccctctttgagacccagatgctactttcccttgcgtccccctctctttcctctcccaatgagccaaccttttgcacttccactagaatgccaggcaggctgggcccccaaaggctcctttttcaaaacctctggaagccgcggttgaatgtgccatgaccctctccctctctggatggcaccatcattgaagctggcgtcatcggagtctcttgttctgttggcgtgctacctggaagatccttctgtcctggacaagaggaattggaagagcattttatgttttaagaacaggctgacacgcagcagctacaacaacagctgagatcacttaataaatggtgctaaacta

SEQ ID NO: 358964 - DNA, 4418 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggcctgggaggagtttcatggcctggtgaacagcatgcggccgctgatcggacgctccccctctgtctctcacactcaggggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgatcgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttgggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagtgtctgctttttgaatccttctgttcgtgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaac

SEQ ID NO: 358965 - DNA, 5181 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggcctgggaggagtttcatggcctggtgaacagcatgcggccgctgatcggacgctccccctctgtctctcacactcaggggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgatcgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttgggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctccagccctttattgggttttctgtttgaaattggcccctactcctctctccagtgtctgctttttgaatccttctgttcgtgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagctcagaaacacgcagtggttcagcactgagtcatgcttgcttctgctacgcaccgatttgttctattccagttttcacgtacatcgttttggtgacatctctgcgttatcatttatttatatggagtgtattttctccaaaattctctacgagggaatgcacctgctcattacagctgctgtctgtgtattcttcacggcaatggatcaaaccagactcacacagtcttagactaagctgaacactgggaaaaataatacatgcttaaagtctgctgttattctaaaatgaccgatatgacttcaacaaagttgatggatactttctttgactgtctacctgaatttagactaagcagtaaatagtttaataaaagatcactttaatatacaaaaaatataacatcgctactagcttctcttctgcgttcccagtagccacagagactggtcgggcgccagtccagcgctccgcagcggcaggagtccagacagccctgtgagttgcggtgcccaagcacatgtccagggcgtggcgctcacgatcaccgtgggatgggtggtcggctccgctgcgagcgtgggggcgcgcgcctctgcgtggggggttacatcgaggcgtgc

SEQ ID NO: 358966 - DNA, 5239 bp, Homo sapiens
  misc_feature (848)..(848): n is a, c, g, or t
  misc_feature (868)..(868): n is a, c, g, or t
  misc_feature (917)..(917): n is a, c, g, or t
  misc_feature (1210)..(1210): n is a, c, g, or t
  misc_feature (1293)..(1293): n is a, c, g, or t
  misc_feature (1305)..(1305): n is a, c, g, or t
  misc_feature (1338)..(1338): n is a, c, g, or t
  misc_feature (1511)..(1511): n is a, c, g, or t
  misc_feature (1581)..(1581): n is a, c, g, or t
  misc_feature (1645)..(1645): n is a, c, g, or t
atgaatgaatgaatgatagtctcgagctgtttaacttcatctctcttatggtttgcatataagattgtgcagtggggctgggcgcggtggctcacgcctgtaatcacaacactttggaaggccaaggcaggtggatcacctgaggtcaggagttcgagaccagcctggctaacatggtgaatggtgaaaccccatctactaaaaatacaaaaattagccaggcgtggtggtgtgtgcctgtagtcccagctactcgggaggctgaggcaggagaatcacttgaacccagaaggcagaggttgcagtgagctgaggcaggctgcaccattgcactccagcctggacaaaaagagcgaaactccatctcaaaaaaacaaacaaaaaaaagattgtgcagtgtagttgtaagattggggagaccaaactgttaaagcgattattgactggggaactggagatggttgacatactttgtcctcaccaagcccctttcagttccttattcacaatgagccactagtgggtgtacttggttctagtgggtatatgtggttttattcaactatgttagggtggataaaggtttacattattgccgattgtattcatatgaccatttactattccgagtcactacatgcagctaagcttagcagttgctgagtataaagcactgccttgaagccctatagatggcgttagttctgacttctttttaccatgtaagacatcacgtgtgcttgtgctagagaggaactaaagggacagccatttcacgcagtgtaaggctgatttctccttaggtgctccccatatctagaagtatgacctgaatctttgtctactcnatacccattgtcagctccanagttgtggtatcttgctgtatgttgatttagagcctgctcagcagtttngcagataccagctatttctcattggaatgttccgtgttttctctttcctcctaaagtgtgcctcttcactggccagtacttactacgtatcctctgtgaataaggaaataatctttcctatcaagacactagtgaacctgtagtcccagctacttgggaggctgagatgggaggatcccttgacaccaggagttagaggctgtgatgagctatgatcatactgctgcgtagaccctgtctcttttttttttctttttttaaggggagggggggtgacactaatgagaaaaacnggactactgtgatgaatacaaataagcatatacttgatggaaaaatataaatctagttttctcacgggattgtgaaggagcgncaaggagaaacntaatttttctagctaagaagagggccttaaacnctagctatgagaagctaagtcctgtatgattttggattggcctggacttagcaacagcaccatgatgtagagtggtatgtgtggtacatgtggttgattctatcacttatgcttagtaactaaacaggtctaagaggtatttacatgtggttgattctatcacttatgcttantaactaaacaggtctaagaggtatttcattcagcaaatgctatatttgccagttaaacaatctttcatcngtaagtgatttggttctaaaaaatgcattcaggctgaggctgtgtgacacttacatacctcaangctaaagagtttccattgtgcaaaaacctggtcctcttactgcatgtgatgactaccctgcagcttgagtgggagagtgcgtattaacatggtttcaccaactaaagctcctggctgaggcttgcatttctcaccaaagattttattcttgaattgcgaatgttacattttttattttgtcaaactagatggtatgtttttcctctaatatgtcttccctcacaacaccacacatgaaaatgagtcctctgaaaaggacagcctgtagtatagtgtcttccatgcttatgttcttaactaaatctcaaccttgggatgcattcaaagaaaagtaaaagacacatgttttttactctggggtcttctctctgcaggtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggcctgggaggagtttcatggcctggtgaacagcatgcggccgctgatcggacgctccccctctgtctctcacactcaggggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgatcgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttgggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagtgtctgctttttgaatccttctgttcgtgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaac

SEQ ID NO: 358967 - DNA, 1321 bp, Homo sapiens
cgctggggctggggcggcgcaaaccctgcggcaccggcttccctgctgggatccggctgcgggacctggcctggactggcggggaggagggggctggggagcaatggataccggagtcccggagaccccagggccgtccgaaccgagggcgaagagctgggcccgggggaggggtggctgtgccgcccggtagggggagattttcggacgccccgccctggtggatgcggattgcctgcgacgtggaggggtggggacctcggcggtttgggtgtttccgcagtctggcagcgctgcctctgaatccagctttccccacacactccctctcccctctgagcctcagttttctcatctgcagagtggggacggtaacaccctttgtcgtagagtttggaggatgcaatgagtttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaaatgccaggcaggctgggcccccaaaggctcctttttcaaaacctctggaagccgcggttgaatgtgccatgaccctctccctctctggatggcaccatcattgaagctggcgtcatcggagtctcttgttctgttggcgtgctacctggaagatccttctgtcctggacaagaggaattggaagagcattttatgttttaagaacaggctgacacgcagcagctacaacaacagctgagatcacttaataaatggtgctaaacta

SEQ ID NO: 358968 - DNA, 2816 bp, Homo sapiens
aacttaggcatagtgcgaggccgggggtgaatcggcaccgaggcgctccccctctgtctctcacactcaggggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgatcgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttgggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagtgtctgctttttgaatccttctgttcgtgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaac

SEQ ID NO: 358969 - DNA, 359 bp, Homo sapiens
ccgaggtcgcgccactgcactccagcctggcaacagagtgagactccgtttcaaaaaaacaaacaaagaaatatcaaagcaatcactaattcatttattctacaatattgagtaaccctccaagggtaagccattttatgctagatgctaagaggacacaaaggtgaatgagactgtggaaggggcttacgtttaatagtaccaataataatactgacatctgttgtgcacgtactctgtgccaggcactgtgctcagcattgtatatccactgattcatttgatcctctcagcagtattgggagatggttgttacaattttcctcattttgcgggtaagaagatgaggcacaaacagg

SEQ ID NO: 358970 - DNA, 2099 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaaatgccaggcaggctgggcccccaaaggctcctttttcaaaacctctggaagccgcggttgaatgtgccatgaccctctccctctctggatggcaccatcattgaagctggcgtcatcggagtctcttgttctgttggcgtgctacctggaagatccttctgtcctggacaagaggaattggaagagcattttatgttttaagaacaggctgacacgcagcagctacaacaacagctgagatcacttaataaatggtgctaaactaacacacacacacacaacaaccccacccacaccccccaacaccaccccaccacgcccccccacccaaccacaccccccacccacccacaaccaacacaccccccc

SEQ ID NO: 358971 - DNA, 4554 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggcctgggaggagtttcatggcctggtgaacagcatgcggccgctgatcggacgctccccctctgtctctcacactcaggggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgatcgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttgggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagtgtctgctttttgaatccttctgttcgtgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaac

SEQ ID NO: 358972 - DNA, 4474 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgatcgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttgggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagtgtctgctttttgaatccttctgttcgtgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaac

SEQ ID NO: 358973 - DNA, 5134 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggcctgggaggagtttcatggcctggtgaacagcatgcggccgctgatcggacgctccccctctgtctctcacactcaggggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgatcgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttgggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagtgtctgctttttgaatccttctgttcgtgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagctcagaaacacgcagtggttcagcactgagtcatgcttgcttctgctacgcaccgatttgttctattccagttttcacgtacatcgttttggtgacatctctgcgttatcatttatttatatggagtgtattttctccaaaattctctacgagggaatgcacctgctcattacagctgctgtctgtgtattcttcacggcaatggatcaaaccagactcacacagtcttagactaagctgaacactgggaaaaataatacatgcttaaagtctgctgttattctaaaatgaccgatatgacttcaacaaagttgatggatactttctttgactgtctacctgaatttagactaagcagtaaatagtttaataaaagatcactttaatatacaaaaaatataacatcgctactagcttctcttctgcgttcccagtagccacagagactggtcgggcgccagtccagcgctccgcagcggcaggagtccagacagccctgtgagttgcggtgcccaagcacatgtccagggcgtggcgctcacgatcaccgtgggatgggtggtcggctccgctgcgagcgtgggggcgcgcgcctctgcgtggggggttacatcgaggcgtgc

SEQ ID NO: 358974 - DNA, 4601 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggcctgggaggagtttcatggcctggtgaacagcatgcggccgctgatcggacgctccccctctgtctctcacactcaggggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgatcgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttgggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctccagccctttattgggttttctgtttgaaattggcccctactcctctctccagtgtctgctttttgaatccttctgttcgtgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaac

SEQ ID NO: 358975 - DNA, 4507 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggcctgggaggagtttcatggcctggtgaacagcatgcggccgctgatcggacgctccccctctgtctctcacactcaggggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgatcgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttgggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagtgtctgctttttgaatccttctgttcgtgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaac

SEQ ID NO: 358976 - DNA, 3511 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggcctgggaggagtttcatggcctggtgaacagcatgcggccgctgatcggacgctccccctctgtctctcacactcaggggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgatcgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctatctccagtgtctgctttttgaatccttctgttcgtgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaac

SEQ ID NO: 358977 - DNA, 1822 bp, Homo sapiens
ctttcttatcattcgtgtgttcattggagtagcacttttaacttccttcaagaacttttcctttgcatttacaacttggctaactgtttgccgcaggaggcctagccttcggcctatctcggcttttgacataccttcctcactcagtttaatcatttctagtttttgatttaaagtgagagatgtgcgactcttcctttcacttgagcacttagaggccattgcagagtcattaattcgcctaatctcaatattgttgtgtctcagggaatagggaggcccaagaagagggagagagatggggaacggtctgtgggtggagcggtcagaacacacacaacattaagttccacgtcttataaaagacgctgtatgtggcaccccaaaacaatgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaagccaggtcatcttcctctttgagtcagccctgcttgcaagatctcagggttacagcccttccctttctcctgggcccggtgttactgcacat

SEQ ID NO: 358978 - DNA, 3880 bp, Homo sapiens
cgctggggctggggcggcgcaaaccctgcggcaccggcttccctgctgggatccggctgcgggacctggcctggactggcggggaggagggggctggggagcaatggataccggagtcccggagaccccagggccgtccgaaccgagggcgaagagctgggcccgggggaggggtggctgtgccgcccggtagggggagattttcggacgccccgccctggtggatgcggattgcctgcgacgtggaggggtggggacctcggcggtttgggtgtttccgcagtctggcagcgctgcctctgaatccagctttccccacacactccctctcccctctgagcctcagttttctcatctgcagagtggggacggtaacaccctttgtcgtagagtttggaggatgcaatgagtttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggcctgggaggagtttcatggcctggtgaacagcatgcggccgctgatcggacgctccccctctgtctctcacactcaggggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgatcgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttgggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagtgtctgctttttgaatccttctgttcgtgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaac

SEQ ID NO: 358979 - DNA, 3540 bp, Homo sapiens
ttcgaattcataagaacaggcaggttagaagcaggatcttggtgaggaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggcctgggaggagtttcatggcctggtgaacagcatgcggccgctgatcggacgctccccctctgtctctcacactcaggggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgatcgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttgggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagtgtctgctttttgaatccttctgttcgtgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaac

SEQ ID NO: 358980 - DNA, 1968 bp, Homo sapiens
caggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggcttgatgtaccttttttcctgttgctcttgaaatatgtttaactcctcatgagagaaccctggattctctatcccctagtccacaaaacaaaccaggcagtggtcagcagctacctttatttggatcacacacgtgagtcagacagtaccactaatcgggccaatatggcttgtgagcaaaatgggtgaaaatagagggaactgactgggacctgttgtctaacatcattttaaggttgaacttgagcaaagacttagagaaagctgatggaatgccaagcatcaacgtgaagagaccctctatgcacacagtggatatgttatgcctggctgtagccaccttctcttctgaaaacaagatgggaatgacggaactgtattaaaagattaagttatccactagggagcatactagcacacttccagatcagccttgagatgctagacttcagatacagggacttgtgtcaggtggcctctagaaatgtggaagactaagatttagaaataaactaatttaaaagcaaacaaacaaaaaaaactttcgcctaggatgatctgtttacaacagaaacaaaaacattttccagtttaatccatttgactgaaagtcattgttgggctgacccttaaggaaaacttaagtttaaacttcctttgcatagtatgttttctcttttttccttgggttagaggtgggaacaagaaaacattgatatagttttgaattaacattaaagaggcaaaatttcacatttaaaatggcccaaaatatcccactattcattttgctgacaggtgatacactcttgagaatcaggagtggagggtttagtcataagcatatatgctgtgggtcaggtgactcatgaacatgtcaaacaggccatgttctttagcagtttctggtctggtcctgcttttagtaatcttgcggtggaactcaggcacacagttatttggtaccacttccttataacctagcccacacccctttgcccaccctcaagccgatcggtctgttcatcccagtgcccttagaaggtgaaggtttgggctgggcccagtggttcacgtctgtaatcccagc

SEQ ID NO: 358981 - DNA, 753 bp, Homo sapiens
caggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacagtgagtattggggagatacagtgccactcagctttgagctgccatttcaactgtaccccaggctcatcttggccctgccacagtggagctgctggctccctggaggttgaatctggcgtctgtgagttcccacgtgccacccttttctgtctgccctcttgtgctctcatgtgtccccaacagggcaccagtcaaaccaaacaccgggatggggaggggagggtgtctttagatatgccatctttcatttcttgctcttagaaaccttaaactttctgggaacacaaccatggcttgggtgtgggaaatagaattatgtactcatgatttgatttcttcagagaaagtcttctcaggggcaggttctctgttatttggagttagaagtgataggtgaagtttctagaagcagctcaacagacttactgaagtcatcttttggctggaaatcttcaggaagcctcctgtcccag

SEQ ID NO: 358982 - DNA, 2004 bp, Homo sapiens
caggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggcttgatgtaccttttttcctgttgctcttgaaatatgtttaactcctcatgagagaaccctggattctctatcccctagtccacaaaacaaaccaggcagtggtcagcagctacctttatttggatcacacacgtgagtcagacagtaccactaatcgggccaatatggcttgtgagcaaaatgggtgaaaatagagggaactgactgggacctgttgtctaacatcattttaaggttgaacttgagcaaagacttagagaaagctgatggaatgccaagcatcaacgtgaagagaccctctatgcacacagtggatatgttatgcctggctgtagccaccttctcttctgaaaacaagatgggaatgacggaactgtattaaaagattaagttatccactagggagcatactagcacacttccagatcagccttgagatgctagacttcagatacagggacttgtgtcaggtggcctctagaaatgtggaagactaagatttagaaataaactaatttaaaagcaaacaaacaaaaaaaactttcgcctaggatgatctgtttacaacagaaacaaaaacattttccagtttaatccatttgactgaaagtcattgttgggctgacccttaaggaaaacttaagtttaaacttcctttgcatagtatgttttctcttttttccttgggttagaggtgggaacaagaaaacattgatatagttttgaattaacattaaagaggcaaaatttcacatttaaaatggcccaaaatatcccactattcattttgctgacaggtgatacactcttgagaatcaggagtggagggtttagtcataagcatatatgctgtgggtcaggtgactcatgaacatgtcaaacaggccatgttctttagcagtttctggtctggtcctgcttttagtaatcttgcggtggaactcaggcacacagttatttggtaccacttccttataacctagcccacacccctttgcccaccctcaagccgatcggtctgttcatcccagtgcccttagaaggtgaaggtttgggctgggcccagtggttcacgtctgtaatcccagc

SEQ ID NO: 358983 - DNA, 3641 bp, Homo sapiens
caggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggtaagatcagcatgtcttccgcctacatcttggcctgggaccctagttcactaccctctcatccctcttccctcttgatttatttagaggggtagagggctgggtgggtgaatttttatttaagattttaataacttctggtccacttaacctactgaacttttgccaatctttatttcctttaatctttattttttttttttttttgagacagagtcttgctgtgtcacccaggctggagtgcactggtgcaatctcggctcactgcaagctctgcctctcagattcaagcgattctcccacctcaccctcccgagtaggtgggactgggattacaggcatgtgccaccatgcctggctaattttgtatttttagtagagacagggtttctccatgttggtcaggctggtctcaaactcccaaccttaggtgatccgcccgcctcagcctcccaaagtgctgggattaaggcgtgagtgactgcgcccggccatttttttgtatttttagtaaagatggggtttcaccatgttggccaggctggttgcaaactcctggcctcaagtgaactgcctaccttggcctcccaaagtgctgggattgcaggtgtgagccaccacacctggcctcgtttcatcttcatatcagcactgatgtagatggtcttatcctcattttataaatgaagaaatgaaggcttacatagtatgattggtgaaaggcacaaggctgaatggcaccaccaaatgtgctattgtgcctgtgtccctggctctaggaatactcctagacctgcctcaaagctgccgtctagttcttgaggcactttgtgatcagtaggttaatccttctgacttaacccaaaagctttggggctccactttcttttcctctctgaagactgacacagctcccagataacccctccccactttgaggacttgatgctgtagatggttttaatgaagccatggccttctctggcaatactgtaggccatcggtgctcggaacttgctcaaatctatagcaaagcagagagaagctcaacagcagcaacttcaagccctaatagcagaaaagaaaatgcagctagaaaggtaagaagtcatgatgtaaagcaagttctttacacagctgaatttccactcttccttctggaatgatcacttcttgtccttattcttcatcattgttttcccaggaatagcatctcacttgtcatcctgatttgaagattttaaaaaataaaattacatttgatgggaaggaaatagaaaacttgttaatatcaaaccacctctagtagtttgagcatgaaagggtccacgaagttggctggctctctgaaagaagactttcctagggctggagatttctcatgggtggctctgggtagggctttgcctctttctttcttcattctgaactcacaccatttcttgaaatcatttaaacctctatatccttctctagaagaattaggtctgtggtttacttcatctttttttcagggcctctaacaattttgtttttcagggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggcttgatgtaccttttttcctgttgctcttgaaatatgtttaactcctcatgagagaaccctggattctctatcccctagtccacaaaacaaaccaggcagtggtcagcagctacctttatttggatcacacacgtgagtcagacagtaccactaatcgggccaatatggcttgtgagcaaaatgggtgaaaatagagggaactgactgggacctgttgtctaacatcattttaaggttgaacttgagcaaagacttagagaaagctgatggaatgccaagcatcaacgtgaagagaccctctatgcacacagtggatatgttatgcctggctgtagccaccttctcttctgaaaacaagatgggaatgacggaactgtattaaaagattaagttatccactagggagcatactagcacacttccagatcagccttgagatgctagacttcagatacagggacttgtgtcaggtggcctctagaaatgtggaagactaagatttagaaataaactaatttaaaagcaaacaaacaaaaaaaactttcgcctaggatgatctgtttacaacagaaacaaaaacattttccagtttaatccatttgactgaaagtcattgttgggctgacccttaaggaaaacttaagtttaaacttcctttgcatagtatgttttctcttttttccttgggttagaggtgggaacaagaaaacattgatatagttttgaattaacattaaagaggcaaaatttcacatttaaaatggcccaaaatatcccactattcattttgctgacaggtgatacactcttgagaatcaggagtggagggtttagtcataagcatatatgctgtgggtcaggtgactcatgaacatgtcaaacaggccatgttctttagcagtttctggtctggtcctgcttttagtaatcttgcggtggaactcaggcacacagttatttggtaccacttccttataacctagcccacacccctttgcccaccctcaagccgatcggtctgttcatcccagtgcccttagaaggtgaaggtttgggctgggcccagtggttcacgtctgtaatcccagc

SEQ ID NO: 358984 - DNA, 2645 bp, Homo sapiens
caggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtaagaagtcatgatgtaaagcaagttctttacacagctgaatttccactcttccttctggaatgatcacttcttgtccttattcttcatcattgttttcccaggaatagcatctcacttgtcatcctgatttgaagattttaaaaaataaaattacatttgatgggaaggaaatagaaaacttgttaatatcaaaccacctctagtagtttgagcatgaaagggtccacgaagttggctggctctctgaaagaagactttcctagggctggagatttctcatgggtggctctgggtagggctttgcctctttctttcttcattctgaactcacaccatttcttgaaatcatttaaacctctatatccttctctagaagaattaggtctgtggtttacttcatctttttttcagggcctctaacaattttgtttttcagggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggcttgatgtaccttttttcctgttgctcttgaaatatgtttaactcctcatgagagaaccctggattctctatcccctagtccacaaaacaaaccaggcagtggtcagcagctacctttatttggatcacacacgtgagtcagacagtaccactaatcgggccaatatggcttgtgagcaaaatgggtgaaaatagagggaactgactgggacctgttgtctaacatcattttaaggttgaacttgagcaaagacttagagaaagctgatggaatgccaagcatcaacgtgaagagaccctctatgcacacagtggatatgttatgcctggctgtagccaccttctcttctgaaaacaagatgggaatgacggaactgtattaaaagattaagttatccactagggagcatactagcacacttccagatcagccttgagatgctagacttcagatacagggacttgtgtcaggtggcctctagaaatgtggaagactaagatttagaaataaactaatttaaaagcaaacaaacaaaaaaaactttcgcctaggatgatctgtttacaacagaaacaaaaacattttccagtttaatccatttgactgaaagtcattgttgggctgacccttaaggaaaacttaagtttaaacttcctttgcatagtatgttttctcttttttccttgggttagaggtgggaacaagaaaacattgatatagttttgaattaacattaaagaggcaaaatttcacatttaaaatggcccaaaatatcccactattcattttgctgacaggtgatacactcttgagaatcaggagtggagggtttagtcataagcatatatgctgtgggtcaggtgactcatgaacatgtcaaacaggccatgttctttagcagtttctggtctggtcctgcttttagtaatcttgcggtggaactcaggcacacagttatttggtaccacttccttataacctagcccacacccctttgcccaccctcaagccgatcggtctgttcatcccagtgcccttagaaggtgaaggtttgggctgggcccagtggttcacgtctgtaatcccagc

SEQ ID NO: 358985 - DNA, 2408 bp, Homo sapiens
caggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtaagaagtcatgatgtaaagcaagttctttacacagctgaatttccactcttccttctggaatgatcacttcttgtccttattcttcatcattgttttcccaggaatagcatctcacttgtcatcctgatttgaagattttaaaaaataaaattacatttgatgggaaggaaatagaaaacttgttaatatcaaaccacctctagtagtttgagcatgaaagggtccacgaagttggctggctctctgaaagaagactttcctagggctggagatttctcatgggtggctctgggtagggctttgcctctttctttcttcattctgaactcacaccatttcttgaaatcatttaaacctctatatccttctctagaagaattaggtctgtggtttacttcatctttttttcagggcctctaacaattttgtttttcagggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggcttgatgtaccttttttcctgttgctcttgaaatatgtttaactcctcatgagagaaccctggattctctatcccctagtccacaaaacaaaccaggcagtggtcagcagctacctttatttggatcacacacgtgagtcagacagtaccactaatcgggccaatatggcttgtgagcaaaatgggtgaaaatagagggaactgactgggacctgttgtctaacatcattttaaggttgaacttgagcaaagacttagagaaagctgatggaatgccaagcatcaacgtgaagagaccctctatgcacacagtggatatgttatgcctggctgtagccaccttctcttctgaaaacaagatgggaatgacggaactgtattaaaagattaagttatccactagggagcatactagcacacttccagatcagccttgagatgctagacttcagatacagggacttgtgtcaggtggcctctagaaatgtggaagactaagatttagaaataaactaatttaaaagcaaacaaacaaaaaaaactttcgcctaggatgatctgtttacaacagaaacaaaaacattttccagtttaatccatttgactgaaagtcattgttgggctgacccttaaggaaaacttaagtttaaacttcctttgcatagtatgttttctcttttttccttgggttagaggtgggaacaagaaaacattgatatagttttgaattaacattaaagaggcaaaatttcacatttaaaatggcccaaaatatcccactattcattttgctgacaggtgatacactcttgagaatcaggagtggagggtttagtcataagcatatatgctgtgggtcaggtgactcatgaacatgtcaaacaggccatgttctttagcagtttctggtctggtcctgcttttagtaatcttgcggtggaactcaggcacacagttatttggtaccacttccttataacctagcccacacccctttgcccaccctcaagccgatcggtctgttcatcccagtgcccttagaaggtgaaggtttgggctgggcccagtggttcacgtctgtaatcccagc

SEQ ID NO: 358986 - DNA, 1864 bp, Homo sapiens
caggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggcttgatgtaccttttttcctgttgctcttgaaatatgtttaactcctcatgagagaaccctggattctctatcccctagtccacaaaacaaaccaggcagtggtcagcagctacctttatttggatcacacacgtgagtcagacagtaccactaatcgggccaatatggcttgtgagcaaaatgggtgaaaatagagggaactgactgggacctgttgtctaacatcattttaaggttgaacttgagcaaagacttagagaaagctgatggaatgccaagcatcaacgtgaagagaccctctatgcacacagtggatatgttatgcctggctgtagccaccttctcttctgaaaacaagatgggaatgacggaactgtattaaaagattaagttatccactagggagcatactagcacacttccagatcagccttgagatgctagacttcagatacagggacttgtgtcaggtggcctctagaaatgtggaagactaagatttagaaataaactaatttaaaagcaaacaaacaaaaaaaactttcgcctaggatgatctgtttacaacagaaacaaaaacattttccagtttaatccatttgactgaaagtcattgttgggctgacccttaaggaaaacttaagtttaaacttcctttgcatagtatgttttctcttttttccttgggttagaggtgggaacaagaaaacattgatatagttttgaattaacattaaagaggcaaaatttcacatttaaaatggcccaaaatatcccactattcattttgctgacaggtgatacactcttgagaatcaggagtggagggtttagtcataagcatatatgctgtgggtcaggtgactcatgaacatgtcaaacaggccatgttctttagcagtttctggtctggtcctgcttttagtaatcttgcggtggaactcaggcacacagttatttggtaccacttccttataacctagcccacacccctttgcccaccctcaagccgatcggtctgttcatcccagtgcccttagaaggtgaaggtttgggctgggcccagtggttcacgtctgtaatcccagc

SEQ ID NO: 358987 - DNA, 1596 bp, Homo sapiens
  misc_feature (43)..(43): n is a, c, g, or t
  misc_feature (45)..(45): n is a, c, g, or t
  misc_feature (88)..(88): n is a, c, g, or t
gttccccccttccccacagtgaaccgagatggcaacactgcantncagacgggaccacagagcaagaatccatttccaaaaaaaaaanatacataaaagtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggcttgatgtaccttttttcctgttgctcttgaaatatgtttaactcctcatgagagaaccctggattctctatcccctagtccacaaaacaaaccaggcagtggtcagcagctacctttatttggatcacacacgtgagtcagacagtaccactaatcgggccaatatggcttgtgagcaaaatgggtgaaaatagagggaactgactgggacctgttgtctaacatcattttaaggttgaacttgagcaaagacttagagaaagctgatggaatgccaagcatcaacgtgaagagaccctctatgcacacagtggatatgttatgcctggctgtagccaccttctcttctgaaaacaagatgggaatgacggaactgtattaaaagattaagttatccactagggagcatactagcacacttccagatcagccttgagatgctagacttcagatacagggacttgtgtcaggtggcctctagaaatgtggaagactaagatttagaaataaactaatttaaaagcaaacaaacaaaaaaaactttcgcctaggatgatctgtttacaacagaaacaaaaacattttccagtttaatccatttgactgaaagtcattgttgggctgacccttaaggaaaacttaagtttaaacttcctttgcatagtatgttttctcttttttccttgggttagaggtgggaacaagaaaacattgatatagttttgaattaacattaaagaggcaaaatttcacatttaaaatggcccaaaatatcccactattcattttgctgacaggtgatacactcttgagaatcaggagtggagggtttagtcataagcatatatgctgtgggtcaggtgactcatgaacatgtcaaacaggccatgttctttagcagtttctggtctggtcctgcttttagtaatcttgcggtggaactcaggcacacagttatttggtaccacttccttataacctagcccacacccctttgcccaccctcaagccgatcggtctgttcatcccagtgcccttagaaggtgaaggtttgggctgggcccagtggttcacgtctgtaatcccagc

SEQ ID NO: 358988 - DNA, 998 bp, Homo sapiens
caggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggtaagatcagcatgtcttccgcctacatcttggcctgggaccctagttcactaccctctcatccctcttccctcttgatttatttagaggggtagagggctgggtgggtgaatttttatttaagattttaataacttctggtccacttaacctactgaacttttgccaatctttatttcctttaatctttattttttttttttttttgagacagagtcttgctgtgtcacccaggctggagtgcactggtgcaatctcggctcactgcaagctctgcctctcagattcaagcgattctcccacctcaccctcccgagtaggtgggactacaggtgtgtgccaccacacccagctgaggtttttgtatttttttttttttttttgagacggagttt

SEQ ID NO: 358989 - DNA, 2080 bp, Homo sapiens
caggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaagagtcttgctgtgtcacccaggctggagtgcactggtgcaatctcggctcactgcaagctctgcctctcagattcaagcgattctcccacctcaccctcccgagtaggtgggagccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggcttgatgtaccttttttcctgttgctcttgaaatatgtttaactcctcatgagagaaccctggattctctatcccctagtccacaaaacaaaccaggcagtggtcagcagctacctttatttggatcacacacgtgagtcagacagtaccactaatcgggccaatatggcttgtgagcaaaatgggtgaaaatagagggaactgactgggacctgttgtctaacatcattttaaggttgaacttgagcaaagacttagagaaagctgatggaatgccaagcatcaacgtgaagagaccctctatgcacacagtggatatgttatgcctggctgtagccaccttctcttctgaaaacaagatgggaatgacggaactgtattaaaagattaagttatccactagggagcatactagcacacttccagatcagccttgagatgctagacttcagatacagggacttgtgtcaggtggcctctagaaatgtggaagactaagatttagaaataaactaatttaaaagcaaacaaacaaaaaaaactttcgcctaggatgatctgtttacaacagaaacaaaaacattttccagtttaatccatttgactgaaagtcattgttgggctgacccttaaggaaaacttaagtttaaacttcctttgcatagtatgttttctcttttttccttgggttagaggtgggaacaagaaaacattgatatagttttgaattaacattaaagaggcaaaatttcacatttaaaatggcccaaaatatcccactattcattttgctgacaggtgatacactcttgagaatcaggagtggagggtttagtcataagcatatatgctgtgggtcaggtgactcatgaacatgtcaaacaggccatgttctttagcagtttctggtctggtcctgcttttagtaatcttgcggtggaactcaggcacacagttatttggtaccacttccttataacctagcccacacccctttgcccaccctcaagccgatcggtctgttcatcccagtgcccttagaaggtgaaggtttgggctgggcccagtggttcacgtctgtaatcccagc

SEQ ID NO: 358990 - DNA, 2205 bp, Homo sapiens
caggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggcttgatgtaccttttttcctgttgctcttgaaatatgtttaactcctcatgagagaaccctggattctctatcccctagtccacaaaacaaaccaggcagtggtcagcagctacctttatttggatcacacacgtgagtcagacagtaccactaatcgggccaatatggcttgtgagcaaaatgggtgaaaatagagggaactgactgggacctgttgtctaacatcattttaaggttgaacttgagcaaagacttagagaaagctgatggaatgccaagcatcaacgtgaagagaccctctatgcacacagtggatatgttatgcctggctgtagccaccttctcttctgaaaacaagatgggaatgacggaactgtattaaaagattaagttatccactagggagcatactagcacacttccagatcagccttgagatgctagacttcagatacagggacttgtgtcaggtggcctctagaaatgtggaagactaagatttagaaataaactaatttaaaagcaaacaaacaaaaaaaactttcgcctaggatgatctgtttacaacagaaacaaaaacattttccagtttaatccatttgactgaaagtcattgttgggctgacccttaaggaaaacttaagtttaaacttcctttgcatagtatgttttctcttttttccttgggttagaggtgggaacaagaaaacattgatatagttttgaattaacattaaagaggcaaaatttcacatttaaaatggcccaaaatatcccactattcattttgctgacaggtgatacactcttgagaatcaggagtggagggtttagtcataagcatatatgctgtgggtcaggtgactcatgaacatgtcaaacaggccatgttctttagcagtttctggtctggtcctgcttttagtaatcttgcggtggaactcaggcacacagttatttggtaccacttccttataacctagcccacacccctttgcccaccctcaagccgatcggtctgttcatcccagtgcccttagaaggtgaaggtttgggctgggcccagtggttcacgtctgtaatcccagc

SEQ ID NO: 358991 - DNA, 3404 bp, Homo sapiens
caggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggtaagatcagcatgtcttccgcctacatcttggcctgggaccctagttcactaccctctcatccctcttccctcttgatttatttagaggggtagagggctgggtgggtgaatttttatttaagattttaataacttctggtccacttaacctactgaacttttgccaatctttatttcctttaatctttattttttttttttttttgagacagagtcttgctgtgtcacccaggctggagtgcactggtgcaatctcggctcactgcaagctctgcctctcagattcaagcgattctcccacctcaccctcccgagtaggtgggactgggattacaggcatgtgccaccatgcctggctaattttgtatttttagtagagacagggtttctccatgttggtcaggctggtctcaaactcccaaccttaggtgatccgcccgcctcagcctcccaaagtgctgggattaaggcgtgagtgactgcgcccggccatttttttgtatttttagtaaagatggggtttcaccatgttggccaggctggttgcaaactcctggcctcaagtgaactgcctaccttggcctcccaaagtgctgggattgcaggtgtgagccaccacacctggcctcgtttcatcttcatatcagcactgatgtagatggtcttatcctcattttataaatgaagaaatgaaggcttacatagtatgattggtgaaaggcacaaggctgaatggcaccaccaaatgtgctattgtgcctgtgtccctggctctaggaatactcctagacctgcctcaaagctgccgtctagttcttgaggcactttgtgatcagtaggttaatccttctgacttaacccaaaagctttggggctccactttcttttcctctctgaagactgacacagctcccagataacccctccccactttgaggacttgatgctgtagatggttttaatgaagccatggccttctctggcaatactgtaggccatcggtgctcggaacttgctcaaatctatagcaaagcagagagaagctcaacagcagcaacttcaagccctaatagcagaaaagaaaatgcagctagaaaggtaagaagtcatgatgtaaagcaagttctttacacagctgaatttccactcttccttctggaatgatcacttcttgtccttattcttcatcattgttttcccaggaatagcatctcacttgtcatcctgatttgaagattttaaaaaataaaattacatttgatgggaaggaaatagaaaacttgttaatatcaaaccacctctagtagtttgagcatgaaagggtccacgaagttggctggctctctgaaagaagactttcctagggctggagatttctcatgggtggctctgggtagggctttgcctctttctttcttcattctgaactcacaccatttcttgaaatcatttaaacctctatatccttctctagaagaattaggtctgtggtttacttcatctttttttcagggcctctaacaattttgtttttcagggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggcttgatgtaccttttttcctgttgctcttgaaatatgtttaactcctcatgagagaaccctggattctctatcccctagtccacaaaacaaaccaggcagtggtcagcagctacctttatttggatcacacacgtgagtcagacagtaccactaatcgggccaatatggcttgtgagcaaaatgggtgaaaatagagggaactgactgggacctgttgtctaacatcattttaaggttgaacttgagcaaagacttagagaaagctgatggaatgccaagcatcaacgtgaagagaccctctatgcacacagtggatatgttatgcctggctgtagccaccttctcttctgaaaacaagatgggaatgacggaactgtattaaaagattaagttatccactagggagcatactagcacacttccagatcagccttgagatgctagacttcagatacagggacttgtgtcaggtggcctctagaaatgtggaagactaagatttagaaataaactaatttaaaagcaaacaaacaaaaaaaactttcgcctaggatgatctgtttacaacagaaacaaaaacattttccagtttaatccatttgactgaaagtcattgttgggctgacccttaaggaaaacttaagtttaaacttcctttgcatagtatgttttctcttttttccttgggttagaggtgggaacaagaaaacattgatatagttttgaattaacattaaagaggcaaaatttcacatttaaaatggcccaaaatatcccactattcattttgctgacaggtgatacactcttgagaatcaggagtggagggtttagtcataagcatatatgctgtgggtcaggtgactcatgaacatgtcaaacaggccatgttctttagcagtttctggtctggtcctgcttttagtaatcttgcggtggaactcaggcacacagttatttggtaccacttccttataacctagcccacacccctttgcccaccctcaagccgatcggtctgttcatcccagtgcccttagaaggtgaaggtttgggctgggcccagtggttcacgtctgtaatcccagc

SEQ ID NO: 358992 - DNA, 2541 bp, Homo sapiens
caggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggaatagcatctcacttgtcatcctgatttgaagattttaaaaaataaaattacatttgatgggaaggaaatagaaaacttgttaatatcaaaccacctctagtagtttgagcatgaaagggtccacgaagttggctggctctctgaaagaagactttcctagggctggagatttctcatgggtggctctgggtagggctttgcctctttctttcttcattctgaactcacaccatttcttgaaatcatttaaacctctatatccttctctagaagaattaggtctgtggtttacttcatctttttttcagggcctctaacaattttgtttttcagggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggcttgatgtaccttttttcctgttgctcttgaaatatgtttaactcctcatgagagaaccctggattctctatcccctagtccacaaaacaaaccaggcagtggtcagcagctacctttatttggatcacacacgtgagtcagacagtaccactaatcgggccaatatggcttgtgagcaaaatgggtgaaaatagagggaactgactgggacctgttgtctaacatcattttaaggttgaacttgagcaaagacttagagaaagctgatggaatgccaagcatcaacgtgaagagaccctctatgcacacagtggatatgttatgcctggctgtagccaccttctcttctgaaaacaagatgggaatgacggaactgtattaaaagattaagttatccactagggagcatactagcacacttccagatcagccttgagatgctagacttcagatacagggacttgtgtcaggtggcctctagaaatgtggaagactaagatttagaaataaactaatttaaaagcaaacaaacaaaaaaaactttcgcctaggatgatctgtttacaacagaaacaaaaacattttccagtttaatccatttgactgaaagtcattgttgggctgacccttaaggaaaacttaagtttaaacttcctttgcatagtatgttttctcttttttccttgggttagaggtgggaacaagaaaacattgatatagttttgaattaacattaaagaggcaaaatttcacatttaaaatggcccaaaatatcccactattcattttgctgacaggtgatacactcttgagaatcaggagtggagggtttagtcataagcatatatgctgtgggtcaggtgactcatgaacatgtcaaacaggccatgttctttagcagtttctggtctggtcctgcttttagtaatcttgcggtggaactcaggcacacagttatttggtaccacttccttataacctagcccacacccctttgcccaccctcaagccgatcggtctgttcatcccagtgcccttagaaggtgaaggtttgggctgggcccagtggttcacgtctgtaatcccagc

SEQ ID NO: 358993 - DNA, 2101 bp, Homo sapiens
caggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggcttgatgtaccttttttcctgttgctcttgaaatatgtttaactcctcatgagagaaccctggattctctatcccctagtccacaaaacaaaccaggcagtggtcagcagctacctttatttggatcacacacgtgagtcagacagtaccactaatcgggccaatatggcttgtgagcaaaatgggtgaaaatagagggaactgactgggacctgttgtctaacatcattttaaggttgaacttgagcaaagacttagagaaagctgatggaatgccaagcatcaacgtgaagagaccctctatgcacacagtggatatgttatgcctggctgtagccaccttctcttctgaaaacaagatgggaatgacggaactgtattaaaagattaagttatccactagggagcatactagcacacttccagatcagccttgagatgctagacttcagatacagggacttgtgtcaggtggcctctagaaatgtggaagactaagatttagaaataaactaatttaaaagcaaacaaacaaaaaaaactttcgcctaggatgatctgtttacaacagaaacaaaaacattttccagtttaatccatttgactgaaagtcattgttgggctgacccttaaggaaaacttaagtttaaacttcctttgcatagtatgttttctcttttttccttgggttagaggtgggaacaagaaaacattgatatagttttgaattaacattaaagaggcaaaatttcacatttaaaatggcccaaaatatcccactattcattttgctgacaggtgatacactcttgagaatcaggagtggagggtttagtcataagcatatatgctgtgggtcaggtgactcatgaacatgtcaaacaggccatgttctttagcagtttctggtctggtcctgcttttagtaatcttgcggtggaactcaggcacacagttatttggtaccacttccttataacctagcccacacccctttgcccaccctcaagccgatcggtctgttcatcccagtgcccttagaaggtgaaggtttgggctgggcccagtggttcacgtctgtaatcccagc

SEQ ID NO: 358994 - DNA, 903 bp, Homo sapiens
  misc_feature (865)..(865): n is a, c, g, or t
caggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttnggtctgcacacccagaccaatattggtctgcacacggg

SEQ ID NO: 358995 - DNA, 436 bp, Homo sapiens
aatgttctgtgtatgtctattaggtccattttgcttaaagtgtagttcaagtttaatatttctttattgattatctcattggatgatctatctattaccaaaagtgagatattgaagccccctactattattgcattgttgtctgtttttgccttcatgtctgttaatatttggttaatatatttaggtcctctggttttgggtgcatatatgattattatatcctccagataaattgacccctttattttaaaattctatcttgtttttctatgtatttctttctgactagacttgtgatatgcgtgtgtttatgtacagaaatttttagtgtttttgttatgttctgttattgacccaaaggccatctttattttctataactgttcaaaatttatattaaaatctacttaggagataatttctttagaaccta

SEQ ID NO: 358996 - DNA, 1570 bp, Homo sapiens
atcacgaccggcggtggcacatgcgcaatagcgagacgctggagcgcggcgtaggtggctgccgagtcttttcctgtttagggtcttatcctggcattgagggcgccggactggcgcttttggccggcttggcattgggtgggcggcttcttgggacccacatgagccagtggcatcatccccgcagtggctggggccggagacgcgacttttcaggacgctcctcagccaagaagaagggcggaaaccacatccccgaaaggtggaaagactatctcccagttggacagcggatgcctgggactcgtttcattgctttcaaagttcctttgcaaaagagttttgaaaagaaacttgctccagaagaatgcttttcccctttggatctttttaacaaaatccgagaacaaaatgaagaacttggactgattattgatttaacatatactcaacgctattataaaccagaggatttgccagaaactgttccttacttaaaaatttttacagttggacatcaagtgcctgatgatgagactatttttaaattcaaacacgctgttaatgggtttttgaaagaaaataaagataatgataaacttattggtgtccactgtacccatggtttaaacaggactggctacctcatttgcagtattcaataggtgccggggacattgcttagaaagacaaaactacattgaagaccttcagaatggtcctatcagaaagaattggaattccagtgtacccaggtcaagtgattttgaagactcagcacatctcatgcaaccagtccacaataagcctgttaaacaaggacctaggtataatctacatcagatccagggtcactcagctcctcgacatttccacacccagacccaaagtttgcaacaatcagtcagaaaattttcagagaatccacatgtttaccagagacaccatctccctcctcctggtccccctggagaggactattcacacaggaggtattcttggaatgtgaagcccaatgccagtcgggcagcccaggatagaagaaggtggtatccttataattactccagactctcctatccagcctgttgggaatggacccagtgatacaaacctgtcctggaattctacctggagaccagagctggcctgaaaattactggtgtgacttttaattagttcaggtctaatcaggtttctttattgttcccttatgtattcaagcttaaggaaaaattgcattgctgtttacctctttgctgataaatttgcagtaattacagcattgcaggaaaaacaatctgttattccagtcttaaatttttctaaaagaagacaatattttagaactgaagcattgagaacttcccttgcaaattatttttaaaattctatcttgtttttctatgtatttctttctgactagacttgtgatatgcgtgtgtttatgtacagaaatttttagtgtttttgttatgttctgttattgacccaaaggccatctttattttctataactgttcaaaatttatattaaaatctacttaggagataatttctttagaaccta

SEQ ID NO: 358997 - DNA, 1211 bp, Homo sapiens
ggatgacggagggcgggcgggggtaatgtcatcgacgaggctcagcgctattataaaccagagggatttgccagaaactgttccttacttaaaaatttttacagttggacatcaagtgcctgatgatgagactatttttaaattcaaacacgctgttaatgggtttttgaaagaaaataaagataatgataaacttattggtgtccactgtacccatggtttaaacaggactggctacctcatttgcagatatttgattgatgtagaaggcgtgaggccagatgatgcaattgaattattcaataggtgccggggacattgcttagaaagacaaaactacattgaagaccttcagaatggtcctatcagaaagaattggaattccagtgtacccaggtcaagtgattttgaagactcagcacatctcatgcaaccagtccacaataagcctgttaaacaaggacctaggtataatctacatcagatccagggtcactcagctcctcgacatttccacacccagacccaaagtttgcaacaatcagtcagaaaattttcagagaatccacatgtttaccagagacaccatctccctcctcctggtccccctggagaggactattcacacaggaggtattcttggaatgtgaagcccaatgccagtcgggcagcccaggatagaagaaggtggtatccttataattactccagactctcctatccagcctgttgggaatggacccagtgatacaaacctgtcctggaattctacctggagaccagagctggcctgaaaattactggtgtgacttttaattagttcaggtctaatcaggtttctttattgttcccttatgtattcaagcttaaggaaaaattgcattgctgtttacctctttgctgataaatttgcagtaattacagcattgcaggaaaaacaatctgttattccagtcttaaatttttctaaaagaagacaatattttagaactgaagcattgagaacttcccttgcaaattatttttaaaattctatcttgtttttctatgtatttctttctgactagacttgtgatatgcgtgtgtttatgtacagaaatttttagtgtttttgttatgttctgttattgacccaaaggccatctttattttctataactgttcaaaatttatattaaaatctacttaggagataatttctttagaaccta

SEQ ID NO: 358998 - DNA, 1801 bp, Homo sapiens
atcacgaccggcggtggcacatgcgcaatagcgagacgctggagcgcggcgtaggtggctgccgagtcttttcctgtttagggtcttatcctggcattgagggcgccggactggcgcttttggccggcttggcattgggtgggcggcttcttgggacccacatgagccagtggcatcatccccgcagtggctggggccggagacgcgacttttcaggacgctcctcagccaagaagaagggcggaaaccacatccccgaaaggtggaaagactatctcccagttggacagcggatgcctgggactcgtttcattgctttcaaagttcctttgcaaaagagttttgaaaagaaacttgctccagaagaatgcttttcccctttggatctttttaacaaaatccgagaacaaaatgaagaacttggactgattattgatttaacatatactcaacgctattataaaccagaggatttgccagaaactgttccttacttaaaaatttttacagttggacatcaagtgcctgatgatgagactatttttaaattcaaacacgctgttaatgggtttttgaaagaaaataaagataatgataaacttattggtgtccactgtacccatggtttaaacaggactggctacctcatttgcagatatttgattgatgtagaaggcgtgaggccagatgatgcaattgaattattcaataggtgccggggacattgcttagaaagacaaaactacattgaagaccttcagaatggtcctatcagaaagaattggaattccagtgtacccaggtcaagtgattttgaagactcagcacatctcatgcaaccagtccacaataagcctgttaaacaaggacctaggtataatctacatcagatccagggtcactcagctcctcgacatttccacacccagacccaaagtttgcaacaatcagtcagaaaattttcagagaatccacatgtttaccagagacaccatctccctcctcctggtccccctggagaggactattcacacaggaggtattcttggaatgtgaagcccaatgccagtcgggcagcccaggatagaagaaggtggtatccttataattactccagactctcctatccagcctgttgggaatggacccagtgatacaaacctgtcctggaattctacctggagaccagagctggcctgaaaattactggtgtgacttttaattagttcaggtctaatcaggtttctttattgttcccttatgtattcaagcttaaggaaaaattgcattgctgtttacctctttgctgataaatttgcagtaattacagcattgcaggaaaaacaatctgttattccagtcttaaatttttctaaaagaagacaatattttagaactgaagcattgagaacttcccttgcaaattatttttaaaattctatcttgtttttctatgtatttctttctgactagacttgtgatatgcgtgtgtttatgtacagaaatttttagtgtttttgttatgttctgttattgacccaaaggccatctttattttctataactgttcaaaatttatattaaaatctacttaggagataatttctttagaacctaaaaaaaaaaaagggggcgcctaaagtttcctcgagggccagttacgcgtcccagctttttgtccagggccttaagggagcgattaagaggaggcgggttacaaggggaggaaacagcgtggactgggagcctcctcggggatattggaccaccagattggcggataaatgggttggacagatcg

SEQ ID NO: 358999 - DNA, 1617 bp, Homo sapiens
atcacgaccggcggtggcacatgcgcaatagcgagacgctggagcgcggcgtaggtggctgccgagtcttttcctgtttagggtcttatcctggcattgagggcgccggactggcgcttttggccggcttggcattgggtgggcggcttcttgggacccacatgagccagtggcatcatccccgcagtggctggggccggagacgcgacttttcaggacgctcctcagccaagaagaagggcggaaaccacatccccgaaaggtggaaagactatctcccagttggacagcggatgcctgggactcgtttcattgctttcaaagttcctttgcaaaagagttttgaaaagaaacttgctccagaagaatgcttttcccctttggatctttttaacaaaatccgagaacaaaatgaagaacttggactgattattgatttaacatatactcaacgctattataaaccagaggatttgccagaaactgttccttacttaaaaatttttacagttggacatcaagtgcctgatgatgagactatttttaaattcaaacacgctgttaatgggtttttgaaagaaaataaagataatgataaacttattggtgtccactgtacccatggtttaaacaggactggctacctcatttgcagatatttgattgatgtagaaggcgtgaggccagatgatgcaattgaattattcaataggtgccggggacattgcttagaaagacaaaactacattgaagaccttcagaatggtcctatcagaaagaattggaattccagtgtacccaggtcaagtgattttgaagactcagcacatctcatgcaaccagtccacaataagcctgttaaacaaggacctaggtataatctacatcagatccagggtcactcagctcctcgacatttccacacccagacccaaagtttgcaacaatcagtcagaaaattttcagagaatccacatgtttaccagagacaccatctccctcctcctggtccccctggagaggactattcacacaggaggtattcttggaatgtgaagcccaatgccagtcgggcagcccaggatagaagaaggtggtatccttataattactccagactctcctatccagcctgttgggaatggacccagtgatacaaacctgtcctggaattctacctggagaccagagctggcctgaaaattactggtgtgacttttaattagttcaggtctaatcaggtttctttattgttcccttatgtattcaagcttaaggaaaaattgcattgctgtttacctctttgctgataaatttgcagtaattacagcattgcaggaaaaacaatctgttattccagtcttaaatttttctaaaagaagacaatattttagaactgaagcattgagaacttcccttgcaaattatttttaaaattctatcttgtttttctatgtatttctttctgactagacttgtgatatgcgtgtgtttatgtacagaaatttttagtgtttttgttatgttctgttattgacccaaaggccatctttattttctataactgttcaaaatttatattaaaatctacttaggagataatttctttagaaccta

SEQ ID NO: 359000 - DNA, 1440 bp, Homo sapiens
atcacgaccggcggtggcacatgcgcaatagcgagacgctggagcgcggcgtaggtggctgccgagtcttttcctgtttagggtcttatcctggcattgagggcgccggactggcgcttttggccggcttggcattgggtgggcggcttcttgggacccacatgagccagtggcatcatccccgcagtggctggggccggagacgcgacttttcaggacgctcctcagccaagaagaagggcggaaaccacatccccgaaaggtggaaagactatctcccagttggacagcggatgcctgggactcgtttcattgctttcaaagttcctttgcaaaagagttttgaaaagaaacttgctccagaagaatgcttttcccctttggatctttttaacaaaatccgagaacaaaatgaagaacttggactgattattgatttaacatatactcaacgctattataaaccagaggatttgccagaaactgttccttacttaaaaatttttacagttggacatcaagtgcctgatgatgagactatttttaaattcaaacacgctgttaatgggtttttgaaagaaaataaagataatgataaacttattggtgtccactgtacccatggtttaaacaggactggctacctcatttgcagatatttgattgatgtagaaggcgtgaggccagatgatgcaattgaattattcaataggtgccggggacattgcttagaaagacaaaactacattgaagaccttcagaatggtcctatcagaaaaaaattttcagagaatccacatgtttaccagagacaccatctccctcctcctggtccccctggagaggactattcacacaggaggtattcttggaatgtgaagcccaatgccagtcgggcagcccaggatagaagaaggtggtatccttataattactccagactctcctatccagcctgttgggaatggacccagtgatacaaacctgtcctggaattctacctggagaccagagctggcctgaaaattactggtgtgacttttaattagttcaggtctaatcaggtttctttattgttcccttatgtattcaagcttaaggaaaaattgcattgctgtttacctctttgctgataaatttgcagtaattacagcattgcaggaaaaacaatctgttattccagtcttaaatttttctaaaagaagacaatattttagaactgaagcattgagaacttcccttgcaaattatttttaaaattctatcttgtttttctatgtatttctttctgactagacttgtgatatgcgtgtgtttatgtacagaaatttttagtgtttttgttatgttctgttattgacccaaaggccatctttattttctataactgttcaaaatttatattaaaatctacttaggagataatttctttagaaccta

SEQ ID NO: 359001 - DNA, 1482 bp, Homo sapiens
atcacgaccggcggtggcacatgcgcaatagcgagacgctggagcgcggcgtaggtggctgccgagtcttttcctgtttagggtcttatcctggcattgagggcgccggactggcgcttttggccggcttggcattgggtgggcggcttcttgggacccacatgagccagtggcatcatccccgcagtggctggggccggagacgcgacttttcaggacgctcctcagccaagaagaagggcggaaaccacatccccgaaaggtggaaagactatctcccagttggacagcggatgcctgggactcgtttcattgctttcaaagttcctttgcaaaagagttttgaaaagaaacttgctccagaagaatgcttttcccctttggatctttttaacaaaatccgagaacaaaatgaagaacttggactgattattgatttaacatatactcaacgctattataaaccagaggatttgccagaaactgttccttacttaaaaatttttacagttggacatcaagtgcctgatgatgagactatttttaaattcaaacacgctgttaatgggtttttgaaagaaaataaagataatgataaacttattggtgtccactgtacccatggtttaaacaggactggctacctcatttgcagacggagtcttgctctgtcacccaggctggagtgcagtggcaccatctcgactcactccaagttctgcttcccaggttcacgccgttctcctgcctcagcctcccaagtagctgggactacaggtgcccgccaccacgcccggctaattttttgtatttttagtagagatgtggtttcaccgtgttagccaggatggtcttgatctcctgaccttgtgatccacccgcctcggcctcccaaagtgctggtattacaggagtgagccaccgcgcctggccagactccttattctttttaaggcctgcgttgttctttgcacaccgatgaacacaaaagtcagaagtttttgatattataaaacattgaagtagtgaacatttctatgtaaatatttttgaatgcatatctcatagccccggaggtaatttcactcaaaatagaatttcttaatcaaatagtatgtgtcgttatgctttttatggatgttgccacactgtactgagttatgtttgttcattcagaaaatatctcctgagcatctattatgtgtaagcagtgtgctgcgtgttagcaaagagactttagctgccctttgtgcgtcctaacagtctagggagggagtagatattaaagaatcacacaaatgcctatacaattacaattccaacaagtgctgagaaggggagtgacatggtacaatgagagcatagaatagggaggatttgacttcaacaagaggactagaggtttctgtggggaggtctctgctgatccttacgttcagaattctctccacaacatccctacctggttaacacctacttata

SEQ ID NO: 359002 - DNA, 529 bp, Homo sapiens
  misc_feature (44)..(44): n is a, c, g, or t
ctcccccaccccccccctctcccacccccccacccccggcccantaggctagtacgaggcctggtgttgctgagagtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359003 - DNA, 953 bp, Homo sapiens
  misc_feature (23)..(23): n is a, c, g, or t
  misc_feature (28)..(28): n is a, c, g, or t
  misc_feature (31)..(31): n is a, c, g, or t
  misc_feature (34)..(34): n is a, c, g, or t
aaaaatataactgtgcctaaggntagcnganggnccctcgcgggtgtgttgagatgtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccagaaaaaaaaaaaaaaaaaaaaaaaaaaaaaaaaaaaaaaaaaacccaaaaaaaaaaaaaaaaaaaaaaaaaaaaacccttgtgggccgcttgggcccattcaattttaaactggaccaagtttatgcttgcggccgaatttcgggctcattgggccaattccccctatagggggtcgttttacaatccactggccggcgtttaaaacgtcgggactggaaaaaccctggggttaccaaattaaatccccttgaaggaaatcccctttttcccagttggggtaatagcaaaaaggcccgaaccgatcccctttccaaacagtggcccaacctgattgggaaatggaaattgtaagctgttaattttttgaaaaattcgcggtaaattttgggaaaataacctattttttaaccaaagggccaaatcgggaaatcccctattaattaa

SEQ ID NO: 359004 - DNA, 842 bp, Homo sapiens
tgaaggtcatcttgcctgtgctccacagcagctccttgccttggcccgaggccgagctcccttcctcccccgtgcacgatgcaccagccacacccccgcccctctgattctagaccaggccaagctggaccccaccccggaacctttgcacctgccatcccgagttctggaaagctcccctcatcctggctttatgtacctgctgcttctcaagacccgaggccttccccatcctccatgaggcatcctcactgcctccccacccacttgctcatcatgtcacctgttttccacacagcccttgttcccatctggagggaagcgtgtgtttagtgtgtagtctccacccgcctcctcctcatcctaagcccagcaggggctcctcatcccgtatggtcatgatgacatccccagtacctagaagatgacatccccagaacctagaaggtgcttggcatgaagtgaaggcatagagggtgttccttgaatgaatgagacactaacagcatttttattgtcttccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359005 - DNA, 727 bp, Homo sapiens
ccctgtgtaagtgaaggtagtgaaatgctccctcacacactctaatgggttagttcaggacagggctgagctgttctcacaaggagaccccaaaacactgcagcttccatgagggagggttcactcctctcactaacagtcccaaggcagctggccatctacgtctgaagtgcaggagtgaagtctaaagggagactcagaccccgggaatatctccggagccatcagctgaagccccaggagaggatgagattatctgggaaggcatatagagtgggaagagggtgaaccctccagtaaatggcgttgagtccctcatgtttccctgtccttagtgtgccgtgaagtccttcccagtccttccctcacatgaagcctttctcgttttattttactcccttcgtgtctcccaacttccttctctcaaccatggacagctgctcaagcacacttaacatgtgttctgatgtgttcacttagatgtatttgtaccctcaaaatcgcatgctggccgtggtgctgtgtgtgatttgcgtaagtgatgttccactctgcgtctcatctgtctctggctctcttcagctttaaccctatccctacatgtggaccgagttcactgcttctgactccggcttctaaatcaattttctatagacatgtctgtgtccttaaactatatatggtggtactgtgtgttaatttgtataaatggcactatgctctaaac

SEQ ID NO: 359006 - DNA, 2424 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359007 - DNA, 2868 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccagaaaaaaaaaaaaaaaaaaaaaaaaaaaaaaaaaaaaaaaaaacccaaaaaaaaaaaaaaaaaaaaaaaaaaaaacccttgtgggccgcttgggcccattcaattttaaactggaccaagtttatgcttgcggccgaatttcgggctcattgggccaattccccctatagggggtcgttttacaatccactggccggcgtttaaaacgtcgggactggaaaaaccctggggttaccaaattaaatccccttgaaggaaatcccctttttcccagttggggtaatagcaaaaaggcccgaaccgatcccctttccaaacagtggcccaacctgattgggaaatggaaattgtaagctgttaattttttgaaaaattcgcggtaaattttgggaaaataacctattttttaaccaaagggccaaatcgggaaatcccctattaattaa

SEQ ID NO: 359008 - DNA, 2503 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtgagtccgggtaactgcggaggatccgagggtcaggctgcagaagcccagaatcccaccccagtccccaagtacagaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359009 - DNA, 2795 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagttgccttgggattcattttaatgtaagctggactttgtcatgccagaaacaaggctcggtcaccgtcagcagtttgcagttttccacctcctcccagttcctccgtgtggttgacccagatatctccgttatgcagccgcctccgggggaccacctccctccctttgagtcagccacagacagcctacttgacggccccgctggcccccacattccactgaactgtgcggatgccacagtgaccccctctcaggcacagcatgacctcctgaagtcgagcctgcttgctttgaacctaccagttaaaatctcctcaaaatgtttggataccgcccattggcccctcacagccacgagctccctgaccagtgtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359010 - DNA, 2748 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaaaaacaaggctcggtcaccgtcagcagtttgcagttttccacctcctcccagttcctccgtgtggttgacccagatatctccgttatgcagccgcctccgggggaccacctccctccctttgagtcagccacagacagcctacttgacggccccgctggcccccacattccactgaactgtgcggatgccacagtgaccccctctcaggcacagcatgacctcctgaagtcgagcctgcttgctttgaacctaccagttaaaatctcctcaaaatgtttggataccgcccattggcccctcacagccacgagctccctgaccagtgtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359011 - DNA, 1892 bp, Homo sapiens
  misc_feature (44)..(44): n is a, c, g, or t
ctcccccaccccccccctctcccacccccccacccccggcccantaggctagtacgaggcctggtgttgctgagagtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359012 - DNA, 1869 bp, Homo sapiens
  misc_feature (1)..(1): n is a, c, g, or t
  misc_feature (13)..(13): n is a, c, g, or t
nattcggcacgangggcagaagcaggaatcccaccccagtccccaagtacaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359013 - DNA, 2387 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagttgccttgggattcattttaatgtaagctggactttgtcatgccagaaacaaggctcggtcaccgtcagcagtttgcagttttccacctcctcccagttcctccgtgtggttgacccagatatctccgttatgcagccgcctccgggggaccacctccctccctttgagtcagccacagacagcctacttgacggccccgctggcccccacattccactgaactgtgcggatgccacagtgaccccctctcaggcacagcatgacctcctgaagtcgagcctgcttgctttgaacctaccagttaaaatctcctcaaaatgtttggataccgcccattggcccctcacagccacgagctccctgaccagtgtgcgtgtgtgtgtgtgtgtgtgtctgtgtgtgtgcttgggacgggtggggaggtcacctttgggtgtgcggtgtgcccccaggacctgtaagtaataaaatctttatttccatcttggatctttcct

SEQ ID NO: 359014 - DNA, 2640 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagttgccttgggattcattttaatgtaagctggactttgtcatgccagaaacaaggctcggtcaccgtcagcagtttgcagttttccacctcctcccagttcctccgtgtggttgacccagatatctccgttatgcagccgcctccgggggaccacctccctccctttgagtcagccacagacagcctacttgacggccccgctggcccccacattccactgaactgtgcggatgccacagtgaccccctctcaggcacagcatgacctcctgaagtcgagcctgcttgctttgaacctaccagttaaaatctcctcaaaatgtttggataccgcccattggcccctcacagccacgagctccctgaccagtgtgcgtgtgtgtgtgtgtgtgtgtctgtgtgtgtgcttgggacgggtggggaggtcacctttgggtgtgcggtgtgcccccaggacctgtaagtaataaaatctttatttccatcttggatctttcctcatcatcaaagggatcctctccgtcttaaggatcacagattaaaagagttcaatgctaaaaaaaaaacagaaaaagaacaaacgaagacgacaacaaacagggggggcgcgaccagaggagataccccacgggaggcgccagaacagagcgcggaaacacaggaacatcatggacgaacaaggggggccccaagaaggcgaacgcgataacacacacggaccacaggtggcagagtgaacacgccgcgcaaat

SEQ ID NO: 359015 - DNA, 2524 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaacctgggtgacaaagcaagactccgtcttggacttgttgcccaagtcatctgggaggcagctggccatctacgtctgaagtgcaggagtgaagtctaaagggagactcagaccccgggaatatctccggagccatcagctgaagccccaggagaggatgagattatctgggaaggcatatagagtgggaagagggtgaaccctccagtaaatggcgttgagtccctcatgtttccctgtccttagtgtgccgtgaagtccttcccagtccttccctcacatgaagcctttctcgttttattttactcccttcgtgtctcccaacttccttctctcaaccatggacagctgctcaagcacacttaacatgtgttctgatgtgttcacttagatgtatttgtaccctcaaaatcgcatgctggccgtggtgctgtgtgtgatttgcgtaagtgatgttccactctgcgtctcatctgtctctggctctcttcagctttaaccctatccctacatgtggaccgagttcactgcttctgactccggcttctaaatcaattttctatagacatgtctgtgtccttaaactatatatggtggtactgtgtgttaatttgtataaatggcactatgctctaaac

SEQ ID NO: 359016 - DNA, 2274 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359017 - DNA, 2353 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtgagtccgggtaactgcggaggatccgagggtcaggctgcagaagcccagaatcccaccccagtccccaagtacagaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359018 - DNA, 1825 bp, Homo sapiens
agcgggtctccgggtcgcggggttcactggcctcctcttgagcttcccaagccaccttgggctccgtgttgggcatggctaaggcggagatgggcggaacttgtgggaagttcgacagctcctccgctgtgaaacttggcgtctaagtcatcccgtggtttctatggaggtgcggccgaagggaggctctgtcgtcgcctaggcaatcgccccacctgcgctgaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactgtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359019 - DNA, 1433 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactgtcaacaagtggaagaagctgtactcgaccccactgctggccatccctacctgcatgggtttcggtgttcaccaggacaaatacagcttccaggtctggtggtacccaacctggggaggagctcaacggcctggtgttcgccaaacatgtc

SEQ ID NO: 359020 - DNA, 900 bp, Homo sapiens
cggccgctccaaaacaaggtgtattgatcggggaaaatcgtgtggccagaggtgacctgaggccagtcacaaagcatgggagggatgctgccaagtgggcaagggtgaaggagttacaggtagagagaacaggagggcaaagaaatggaaaccctggcacatggcgtgtttgaaaaagcagaagaggtttgaataatggattggttgattcagtgttcacagtgactttaagaacataacttccctggatggcagaggggactgtgtatatatcttaggctgtgtatatatcttaggcattctgttttaaaaggttgctctcctttccctaagagacctttcacatgtgtttctgtcccttcaggtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359021 - DNA, 1029 bp, Homo sapiens
agcgggtctccgggtcgcggggttcactggcctcctcttgagcttcccaagccaccttgggctccgtgttgggcatggctaaggcggagatgggcggaacttgtgggaagttcgacagctcctccgctgtgaaacttggcgtctaagtcatcccgtggtttctatggaggtgcggccgaagggaggctctgtcgtcgcctaggcaatcgccccacctgcgctgaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagacctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359022 - DNA, 657 bp, Homo sapiens
gtgttcagcaccaagaacagcaggcagcgggacacaaaagggaagtgctagggatgtgggttcagcaccagggacagcggagcacaaaagggaagcgctgtgggtatgagttcagcaccaaggacagtgggcagctgatcctagcgggcgtgctaggcatgcacttcagacatgaatatcagttgcccaggccgggcacggtggttcacgccttaatcccagcactttgggaggccaaggcagatggatctcgaggtcagcagttcgagaccagcctggccaacatagtgaaactctgtctctactgaaaataacaaaaattagccgaagcagtggtgggcacctgtaatccctgctgaggcaggaaaattgcttgaacccgggaggtggaggttgcagtgagccgagctctcgccactgcattccagcctgggtgacaaagcaagactccgtcttggacttgttgcccaagtcatctgggaggcagctggccatctacgtctgaagtgcaggagtgaagtctaaagggagactcagaccccgggaatatctccggagccatcagctgaagccccaggagaggatgagattatctgggaaggcatatagagtgggaagagggtgaaccctccagtaaatggcgttgagtccctcatg

SEQ ID NO: 359023 - DNA, 2102 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359024 - DNA, 2042 bp, Homo sapiens
agcgggtctccgggtcgcggggttcactggcctcctcttgagcttcccaagccaccttgggctccgtgttgggcatggctaaggcggagatgggcggaacttgtgggaagttcgacagctcctccgctgtgaaacttggcgtctaagtcatcccgtggtttctatggaggtgcggccgaagggaggctctgtcgtcgcctaggcaatcgccccacctgcgctgaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359025 - DNA, 2131 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagtcgatacacagctcctccgtgtac

SEQ ID NO: 359026 - DNA, 2420 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagttgccttgggattcattttaatgtaagctggactttgtcatgccagaaacaaggctcggtcaccgtcagcagtttgcagttttccacctcctcccagttcctccgtgtggttgacccagatatctccgttatgcagccgcctccgggggaccacctccctccctttgagtcagccacagacagcctacttgacggccccgctggcccccacattccactgaactgtgcggatgccacagtgaccccctctcaggcacagcatgacctcctgaagtcgagcctgcttgctttgaacctaccagttaaaatctcctcaaaatgtttggataccgcccattggcccctcacagccacgagctccctgaccagtgtgcgtgtgtgtgtgtgtgtgtgtctgtgtgtgtgcttgggacgggtggggaggtcacctttgggtgtgcggtgtgcccccaggacctgtaagtaataaaatctttatttccatcttggatctttcctccagcctgggcaacataggtgagaccctgtctc

SEQ ID NO: 359027 - DNA, 2272 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359028 - DNA, 1843 bp, Homo sapiens
tgtgtgttttttgtttctcgtatgtgtacttcctcaagacgcgtcgtagagagttcaccagtaatcagtgcggaccgtgaccctctaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359029 - DNA, 1591 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacagtacgttctggtgtaccagctggggagaagctcagtcggctggttaggccaaagattgtgaaaagttgcttgaggtggcgcggggggagccggtccctcgatgagttttggaatgcatgcaattgggccacacgaagagagtgagataagatgagaa

SEQ ID NO: 359030 - DNA, 1411 bp, Homo sapiens
agggctgtgcgggcgacttctttcgccttcccatctcctcctgcttcttcagccttagcactgtgggagtagagtagaaagagaatcaggaccaggcggcatcagtttgtagtccagatttttaccttgttaaagaatcatctaattagcttcttgcctttactagaagtcagggagtgttaaccttttccgaagagcaagcggtaggttgccatggaaacgcgttgtgacgggtttctgagaaaacaagcggaagtaaggggcggagttgaggcagaagtttaggtaatgtgacctctgattggtggagaggtacctcacggtgcattccgattggtctgacactgacacatgcgcagtagaaccagaaggcgttccaaagcggctagaacggaggggagggggatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagacctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccaga

SEQ ID NO: 359031 - DNA, 309 bp, Homo sapiens
gtgagtgcttggggggtggttgccctgatgggtgtgtgagtgtgagtgtgggggctggctgccctgctgggtgtgtgagtgtgagtgtggggggtggttgcattgctgggtggatgagtgtgagagtgtgggtagctgccctgctaggtgtgtgaatatacgagtgtgaggtggttgctctattgggtgtgtgctctgggtatggctagggctgagttagtgacatgtgcagagctgttagggatgtaggtgtggctgggtaagagacatgggcggggctgggtgaaggacgtgggtggtgctggatta

SEQ ID NO: 359032 - DNA, 1964 bp, Homo sapiens
  misc_feature (1655)..(1655): n is a, c, g, or t
  misc_feature (1760)..(1760): n is a, c, g, or t
acttccgctcctgcgcgctgaggctccggcggacctctggtggacatggctgcttcccgcttacccccagcgacgctaacgttaaagcagttcgtaagaaggcaacaagttcttctcctctacagaaggattttgcaaacaattcggcaagttccaaatgattctgatcgcaaatacctgaaagattgggcaagagaagaattcagaagaaacaaaagtgccaccgaagaggcttcgcccacgactgaagcgcaagacctgaaggaggcaaacggcattgttacaaccactggtgtgcgcagcatctgtgtgagagaattctccttggacctggggctctgacctaatggaatttacagcttagagggtgagagcaggtgttcacatcaagcaagcacctctggaccacctaccatcctcctaggtcttgtcctgggcaccacggggactcggagacagggcacacccttcgtggatgagcgccgcgatgatctccgtgttccccaccactgtggcccggtgcaaggcggtctggtccccctgcaaagtgacacaaaggcaggaacagcagtcagctcccctgcaccccctgcttgcactactcacttgacacttggacacaaggacccctcccgtccccacacagagcagagcggttattcgcagaagggcttggttaccacaggcaaggcgggctttgtggtcttgttagtagacaacgcacgctggcagagaaattttgttcataaactaagagggggaccttaagccgacagcaagaatagccctcggccacagagccaacctcaaaatgagggtcaggctctctcctgccatccaggggctatgactatcacaggtgtgaagagtgggtgtgagggcaggtgtgtgctatgcaattaaagcagcaatgcctggaatctctactgcctgccgagtttccagcttgcagggggaccactgtccagctctgccagttagcagcactcatgatttgatgacaggcgggtcatttgttcattgacctgtactagtcaacggcaatgcaggggtttgccctatttcatctgaggactccagggactgcagctatcactgcatatttctaagaagcctcttcagagagttcatgacaacatcctcactgatttatgctgcactctgagccctcttctctatgatcggattcctgggattgccggccgttgttctcctttaggcgccaaagggaacttgactcttcctaattgcagttgagtgaaggatgaaacactcccagaggtaagcaggtcaagactgtaacaggagagttctgaagtctctaagagcaccctttatctctgacaggtcctcaggaagctaagttgaggtaaatcaagctgagcctgtggtccagccttgaaagggaggatgggtgggcagtgtggaaatgttctggtggaaagcaatgagcacgagacaaggggtcaggaggcctgggctgtgcatggcttgctagaagcctgtcaccctgctggacctcaggtgtgtcaccctggatgatcccagggtccctccattgccttcttggattctatgatgtggctggtcagagttttgtgaagtttcctggcagagcaccagaggggcaaagaaaacattctggggcgtccctngtgcttggcccaaaagaggacagaggccatcataagataaaacagattttttaaaagaaggatgcactgctacctataaacaaccttaacgaaatactgattctncttactaaactccccagatctgtaacaaacaatgcacattaaaaacatgtaatctgaaacaaagttctaaagatagatggtggtgatggttgcacaacaatgtgagtgtacttaatgccactgaaccgtatacgtaaatatgttcagacagtaaatttaatgctatgtatattttattacaataaaaaatcctagttaaaactc

SEQ ID NO: 359033 - DNA, 2587 bp, Homo sapiens
acttccgctcctgcgcgctgaggctccggcggacctctggtggacatggctgcttcccgcttacccccagcgacgctaacgttaaagcagttcgtaagaaggcaacaagttcttctcctctacagaaggattttgcaaacaattcggcaagttccaaatgattctgatcgcaaatacctgaaagattgggcaagagaagaattcagaagaaacaaaagtgccaccgaagaggatacaatccggatgatgattactcaaggcaatatgcagctcaaggagttagaaaaaacacttgctttagcaaaatcttaactatagcattattctgaaggattttcaaagtctccatgtgttttgttgcatttaggattaacaatggacaacacaaagcccagtcttactatttatatgtacagtatttggtgatagagagcaaaggaaaaacacatcagaacagttgccttaacactgaaaaacataccctgcattttgaaaatgtttatggatgtctcagcagttcttaaaagaagaaaaaaaccactaacaaatggccagtagatgctggacacaatcattagggaagtgtaaatcaaaactactatgaggtcgggtgtagtggctcatgcttgtaatcccagtactttaggaggctgtggtaggtggatcacttgaggtcaggagttcaagaccagcctggccaacatggtgaaacctcatctctactaaaaatacaaaaattagcttggtgtggtggtgcattgcctgtagtcccagctacttgggaggctgaggcaggagaatcacttgaacccaggaagtggaggttgcagtgagctgaggtcgtgccactgcacttcagcctgggtgacagagtgagacagtctctaaaaaaaaaaaaaaaaaaacaaccctgagattcacattcactagaatggctgtaattaaaaagagaaataataataagtcttggtgaagatgtacagaaattacagaaccctcatacattgctggtgggaatgtaaaatggtgtagccacttcagaaaacagacggtcagttcctcaaaagatgaaacagctgctgtatgagttagcacttctaccccatgcccatagccattatttggcactaaaaagaaacgaaggacttatatatactaaacatggataaaccttgaaaacgttaagtgaaagaagccggtcacaaaagatcacatgatgattccattcatacgaaatgtccagaataggcagaaagattagtggttgcctaggctggctgtagatggaatggagtaactgctaatgggtgtagggttccttttcagggtgatgaaaatatcctacagttagcttgtggtgtaggctgcacaactcttgaatatattcaaatccactgaactgtacattttaaatgtaaggtatgaattgtatctcaataaagctgttattaaaaaactcttgaggtgtaggactgaaagtatactgacaccaggagataccctggaactttctcgaaaaatcctgcattatccctgagggttgttcaggtacgttcttcagatgtgtcatagtttgatagagaactcatcaaaaagatcaccactgggaatctagatctttgttgaaaagggaagagaaagagaagcttaatgagcacattgaagcacttaccagaaagaagagggaagacttctggatgaaacctctgtgagtaccttaacattcacatggaagtagtaaaaataagattctgggtgcagttctccaatgacaggaaaaaaaacaaagagaatttgaagaatacgtcagagacaaatacattacaaccaaaattgacttcaaggcacttttgaaggagatcaaatttataacaaaataatttagtgaaagtgaaagcttgtggaagatgttggaatcatccatcctgaaaattgaagtcttctgtttatcaacagaacagctaagaagctaatctaagaatgaccagcacctgaaagatgtagacaacattttgcagaatgataaatggtatccagtactggactgtgtctgagaggcatcaactgaatgtggatgttaatgacctggactgtcagggtccacctctacctcccagagcctcagagcccacaagacaaaataattctgaatactgttccatgggggtaatctactaattcaaaatgcctgcctgtgccaattttcaggtttttatgtagataagtattagttaacctgttgcaaaatgatctgacaaacagaagcatttgtgacgtttctgaacagagaacactttggaaatattttttgtgtgacatgattgatagatacatgctatctctagtaaatctaaaatcttgaaactcaaaatcatccttttatgggtgtagaagtcagtgatttaatgatgctcttcctaacagtggtgtgcatggaaaggttttcattaaagagcgtatgtggtttgcatttgcaagattcaactagcacagactccaagaaaacctaagtttttttgttttttaaagcaggtaaggccgggcactgtggcttacacaagtaatccacacactttgggaggctgag

SEQ ID NO: 359034 - DNA, 2639 bp, Homo sapiens
ctcaacgctttatacttcattgggtaaatggttggctaaggtggtctggtagtaaggtggagtggtttggtgcgatcgcgtgagacagcgtcaggcgcttgatttccctgagtcccggtgcctcagctgcccagtgcccacgttcgtaagaaggcaacaagttcttctcctctacagaaggattttgcaaacaattcggcaagttccaaatgattctgatcgcaaatacctgaaagattgggcaagagaagaattcagaagaaacaaaagtgccaccgaagaggatacaatccggatgatgattactcaaggcaatatgcagctcaaggagttagaaaaaacacttgctttagcaaaatcttaactatagcattattctgaaggattttcaaagtctccatgtgttttgttgcatttaggattaacaatggacaacacaaagcccagtcttactatttatatgtacagtatttggtgatagagagcaaaggaaaaacacatcagaacagttgccttaacactgaaaaacataccctgcattttgaaaatgtttatggatgtctcagcagttcttaaaagaagaaaaaaaccactaacaaatggccagtagatgctggacacaatcattagggaagtgtaaatcaaaactactatgaggtcgggtgtagtggctcatgcttgtaatcccagtactttaggaggctgtggtaggtggatcacttgaggtcaggagttcaagaccagcctggccaacatggtgaaacctcatctctactaaaaatacaaaaattagcttggtgtggtggtgcattgcctgtagtcccagctacttgggaggctgaggcaggagaatcacttgaacccaggaagtggaggttgcagtgagctgaggtcgtgccactgcacttcagcctgggtgacagagtgagacagtctctaaaaaaaaaaaaaaaaaaacaaccctgagattcacattcactagaatggctgtaattaaaaagagaaataataataagtcttggtgaagatgtacagaaattacagaaccctcatacattgctggtgggaatgtaaaatggtgtagccacttcagaaaacagacggtcagttcctcaaaagatgaaacagctgctgtatgagttagcacttctaccccatgcccatagccattatttggcactaaaaagaaacgaaggacttatatatactaaacatggataaaccttgaaaacgttaagtgaaagaagccggtcacaaaagatcacatgatgattccattcatacgaaatgtccagaataggcagaaagattagtggttgcctaggctggctgtagatggaatggagtaactgctaatgggtgtagggttccttttcagggtgatgaaaatatcctacagttagcttgtggtgtaggctgcacaactcttgaatatattcaaatccactgaactgtacattttaaatgtaaggtatgaattgtatctcaataaagctgttattaaaaaactcttgaggtgtaggactgaaagtatactgacaccaggagataccctggaactttctcgaaaaatcctgcattatccctgagggttgttcaggtacgttcttcagatgtgtcatagtttgatagagaactcatcaaaaagatcaccactgggaatctagatctttgttgaaaagggaagagaaagagaagcttaatgagcacattgaagcacttaccagaaagaagagggaagacttctggatgaaacctctgtgagtaccttaacattcacatggaagtagtaaaaataagattctgggtgcagttctccaatgacaggaaaaaaaacaaagagaatttgaagaatacgtcagagacaaatacattacaaccaaaattgacttcaaggcacttttgaaggagatcaaatttataacaaaataatttagtgaaagtgaaagcttgtggaagatgttggaatcatccatcctgaaaattgaagtcttctgtttatcaacagaacagctaagaagctaatctaagaatgaccagcacctgaaagatgtagacaacattttgcagaatgataaatggtatccagtactggactgtgtctgagaggcatcaactgaatgtggatgttaatgacctggactgtcagggtccacctctacctcccagagcctcagagcccacaagacaaaataattctgaatactgttccatgggggtaatctactaattcaaaatgcctgcctgtgccaattttcaggtttttatgtagataagtattagttaacctgttgcaaaatgatctgacaaacagaagcatttgtgacgtttctgaacagagaacactttggaaatattttttgtgtgacatgattgatagatacatgctatctctagtaaatctaaaatcttgaaactcaaaatcatccttttatgggtgtagaagtcagtgatttaatgatgctcttcctaacagtggtgtgcatggaaaggttttcattaaagagcgtatgtggtttgcatttgcaagattcaactagcacagactccaagaaaacctaagtttttttgttttttaaagcaggtaaggccgggcactgtggcttacacaagtaatccacacactttgggaggctgag

SEQ ID NO: 359035 - DNA, 2771 bp, Homo sapiens
ctcaacgctttatacttcattgggtaaatggttggctaaggtggtctggtagtaaggtggagtggtttggtgcgatcgcgtgagacagcgtcaggcgcttgatttccctgagtcccggtgcctcagctgcccagtgcccacggtaaaagtctattgcactgagctgtggcaaacagcaaatgagattaccaaagatttgaacaactgttaatttagaaaaagtgctgtcgttgtaataacaacttctaggagaccggcagcccttttcagcccgttcgtaagaaggcaacaagttcttctcctctacagaaggattttgcaaacaattcggcaagttccaaatgattctgatcgcaaatacctgaaagattgggcaagagaagaattcagaagaaacaaaagtgccaccgaagaggatacaatccggatgatgattactcaaggcaatatgcagctcaaggagttagaaaaaacacttgctttagcaaaatcttaactatagcattattctgaaggattttcaaagtctccatgtgttttgttgcatttaggattaacaatggacaacacaaagcccagtcttactatttatatgtacagtatttggtgatagagagcaaaggaaaaacacatcagaacagttgccttaacactgaaaaacataccctgcattttgaaaatgtttatggatgtctcagcagttcttaaaagaagaaaaaaaccactaacaaatggccagtagatgctggacacaatcattagggaagtgtaaatcaaaactactatgaggtcgggtgtagtggctcatgcttgtaatcccagtactttaggaggctgtggtaggtggatcacttgaggtcaggagttcaagaccagcctggccaacatggtgaaacctcatctctactaaaaatacaaaaattagcttggtgtggtggtgcattgcctgtagtcccagctacttgggaggctgaggcaggagaatcacttgaacccaggaagtggaggttgcagtgagctgaggtcgtgccactgcacttcagcctgggtgacagagtgagacagtctctaaaaaaaaaaaaaaaaaaacaaccctgagattcacattcactagaatggctgtaattaaaaagagaaataataataagtcttggtgaagatgtacagaaattacagaaccctcatacattgctggtgggaatgtaaaatggtgtagccacttcagaaaacagacggtcagttcctcaaaagatgaaacagctgctgtatgagttagcacttctaccccatgcccatagccattatttggcactaaaaagaaacgaaggacttatatatactaaacatggataaaccttgaaaacgttaagtgaaagaagccggtcacaaaagatcacatgatgattccattcatacgaaatgtccagaataggcagaaagattagtggttgcctaggctggctgtagatggaatggagtaactgctaatgggtgtagggttccttttcagggtgatgaaaatatcctacagttagcttgtggtgtaggctgcacaactcttgaatatattcaaatccactgaactgtacattttaaatgtaaggtatgaattgtatctcaataaagctgttattaaaaaactcttgaggtgtaggactgaaagtatactgacaccaggagataccctggaactttctcgaaaaatcctgcattatccctgagggttgttcaggtacgttcttcagatgtgtcatagtttgatagagaactcatcaaaaagatcaccactgggaatctagatctttgttgaaaagggaagagaaagagaagcttaatgagcacattgaagcacttaccagaaagaagagggaagacttctggatgaaacctctgtgagtaccttaacattcacatggaagtagtaaaaataagattctgggtgcagttctccaatgacaggaaaaaaaacaaagagaatttgaagaatacgtcagagacaaatacattacaaccaaaattgacttcaaggcacttttgaaggagatcaaatttataacaaaataatttagtgaaagtgaaagcttgtggaagatgttggaatcatccatcctgaaaattgaagtcttctgtttatcaacagaacagctaagaagctaatctaagaatgaccagcacctgaaagatgtagacaacattttgcagaatgataaatggtatccagtactggactgtgtctgagaggcatcaactgaatgtggatgttaatgacctggactgtcagggtccacctctacctcccagagcctcagagcccacaagacaaaataattctgaatactgttccatgggggtaatctactaattcaaaatgcctgcctgtgccaattttcaggtttttatgtagataagtattagttaacctgttgcaaaatgatctgacaaacagaagcatttgtgacgtttctgaacagagaacactttggaaatattttttgtgtgacatgattgatagatacatgctatctctagtaaatctaaaatcttgaaactcaaaatcatccttttatgggtgtagaagtcagtgatttaatgatgctcttcctaacagtggtgtgcatggaaaggttttcattaaagagcgtatgtggtttgcatttgcaagattcaactagcacagactccaagaaaacctaagtttttttgttttttaaagcaggtaaggccgggcactgtggcttacacaagtaatccacacactttgggaggctgag

SEQ ID NO: 359036 - DNA, 2440 bp, Homo sapiens
acttccgctcctgcgcgctgaggctccggcggacctctggtggacatggctgcttcccgcttacccccagcgacgctaacgttaaagcagttcgtaagaaggcaacaagttcttctcctctacagaaggattttgcaaacaattcggcaagttccaaatgattctgatcgcaaatacctgaaagattgggcaagagaagaattcagaagaaacaaaagtgccaccgaagaggatacaatccggatgatgattactcaaggcaatatgcagctcaaggagttagaaaaaacacttgctttagcaaaatcttaactatagcattattctgaaggattttcaaagtctccatgtgttttgttgcatttaggattaacaatggacaacacaaagcccagtcttactatttatatgtacagtatttggtgatagagagcaaaggaaaaacacatcagaacagttgccttaacactgaaaaacataccctgcattttgaaaatgtttatggatgtctcagcagttcttaaaagaagaaaaaaaccactaacaaatggccacatggtgaaacctcatctctactaaaaatacaaaaattagcttggtgtggtggtgcattgcctgtagtcccagctacttgggaggctgaggcaggagaatcacttgaacccaggaagtggaggttgcagtgagctgaggtcgtgccactgcacttcagcctgggtgacagagtgagacagtctctaaaaaaaaaaaaaaaaaaacaaccctgagattcacattcactagaatggctgtaattaaaaagagaaataataataagtcttggtgaagatgtacagaaattacagaaccctcatacattgctggtgggaatgtaaaatggtgtagccacttcagaaaacagacggtcagttcctcaaaagatgaaacagctgctgtatgagttagcacttctaccccatgcccatagccattatttggcactaaaaagaaacgaaggacttatatatactaaacatggataaaccttgaaaacgttaagtgaaagaagccggtcacaaaagatcacatgatgattccattcatacgaaatgtccagaataggcagaaagattagtggttgcctaggctggctgtagatggaatggagtaactgctaatgggtgtagggttccttttcagggtgatgaaaatatcctacagttagcttgtggtgtaggctgcacaactcttgaatatattcaaatccactgaactgtacattttaaatgtaaggtatgaattgtatctcaataaagctgttattaaaaaactcttgaggtgtaggactgaaagtatactgacaccaggagataccctggaactttctcgaaaaatcctgcattatccctgagggttgttcaggtacgttcttcagatgtgtcatagtttgatagagaactcatcaaaaagatcaccactgggaatctagatctttgttgaaaagggaagagaaagagaagcttaatgagcacattgaagcacttaccagaaagaagagggaagacttctggatgaaacctctgtgagtaccttaacattcacatggaagtagtaaaaataagattctgggtgcagttctccaatgacaggaaaaaaaacaaagagaatttgaagaatacgtcagagacaaatacattacaaccaaaattgacttcaaggcacttttgaaggagatcaaatttataacaaaataatttagtgaaagtgaaagcttgtggaagatgttggaatcatccatcctgaaaattgaagtcttctgtttatcaacagaacagctaagaagctaatctaagaatgaccagcacctgaaagatgtagacaacattttgcagaatgataaatggtatccagtactggactgtgtctgagaggcatcaactgaatgtggatgttaatgacctggactgtcagggtccacctctacctcccagagcctcagagcccacaagacaaaataattctgaatactgttccatgggggtaatctactaattcaaaatgcctgcctgtgccaattttcaggtttttatgtagataagtattagttaacctgttgcaaaatgatctgacaaacagaagcatttgtgacgtttctgaacagagaacactttggaaatattttttgtgtgacatgattgatagatacatgctatctctagtaaatctaaaatcttgaaactcaaaatcatccttttatgggtgtagaagtcagtgatttaatgatgctcttcctaacagtggtgtgcatggaaaggttttcattaaagagcgtatgtggtttgcatttgcaagattcaactagcacagactccaagaaaacctaagtttttttgttttttaaagcaggtaaggccgggcactgtggcttacacaagtaatccacacactttgggaggctgag

SEQ ID NO: 359037 - DNA, 670 bp, Homo sapiens
ctcaacgctttatacttcattgggtaaatggttggctaaggtggtctggtagtaaggtggagtggtttggtgcgatcgcgtgagacagcgtcaggcgcttgatttccctgagtcccggtgcctcagctgcccagtgcccacggtaaaagtctattgcactgagctgtggcaaacagcaaatgagattaccaaagatttgaacaactgttaatttagaaaaagtgctgtcgttgtaataacaacttctaggagaccggcagcccttttcagcccgttcgtaagaaggcaacaagttcttctcctctacagaaggattttgcaaacaattcggcaagttccaaatgattctgatcgcaaatacctgaaagattgggcaagagaagaattcagaagaaacaaaagtgccaccgaagagagaacaaaatcatggtgaggacagatcctaaccctttttattgatcagtgaatttttttttttaagtttagcagacatcttggaatatagtgccactgagctggtatatcttgatcattgcttgtaatgttaccgattttaaattattattttaaaatttagtattttaaaatatgtagataaaagagtatctacactcttcagcatcatcacttgacttttatgttgtacattttatatgtatgtatgtggaac

SEQ ID NO: 359038 - DNA, 486 bp, Homo sapiens
tggtgtgcgcagcatctgtgtgagagaattctccttggacctggggctctgacctaatggaatttacagcttagagggtgagagcaggtgttcacatcaagcaagcacctctggaccacctaccatcctcctaggtcttgtcctgggcaccacggggactcggagacaggtaggatattatccctgacctcaagaagcttaaagtctatgatgataataactacagacactgatgctgggccgggactgccaactacatgcacagagactgtgctccagggagtgccattcacataaactaggatatgaatggcgtctcctggagttgtgcaacgcagcagccccgtgtgaggcacagtctcactctccatcttggtacactggacttgagctagcccagcagatgttcccttggccaaactgtgtccaagtcacatcaatttgattcaaaatattattaaagtgtatctatgagccatagtacca

SEQ ID NO: 359039 - DNA, 2011 bp, Homo sapiens
  misc_feature (2007)..(2011): n is a, c, g, or t
gtcctgaacgcccatcaagcccatggcccttgtgatccaggtggggaaactaaggcccagagaagtgaggaccccgcagactatcaatcccagtctcttcccctcactccctgtgaagctctccagcatcatcgaggtcccatcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattannnnn

SEQ ID NO: 359040 - DNA, 561 bp, Homo sapiens
  misc_feature (1)..(1): n is a, c, g, or t
nagcccgttcctgctccgcgcttctggagcactggccaaggcgggccgattcaggacccaggttacttgggcggcgagctggactgtttctactcctccctcctcctccactgcggggtctgaccctactccttgtgtgaggactcctctagttcagagacatattctgttcaccaaacttgactgcgctctatcgaggtcgttaaattcttcggaaatgcctcacatatagtttggcagctaggtatctgatttcatatgcctgtttgctcgttttgcaagacaacatctgcctatcgtcatactgtttctgtgatctgagaatgaatgggctctcctggcacattagaggaatagcacggaggtcactatagctggagcagagtgagggaggggagcacagttggagaggaagggatggggaacccgatggtacagggccttgtaggccgttgtagggagattggcttttacgcagaaggcaacggggatccctggtagggttctcagtagaggaggaatgtgatcggaattacgtcttacactgatcgttctagcagt

SEQ ID NO: 359041 - DNA, 2122 bp, Homo sapiens
  misc_feature (2118)..(2122): n is a, c, g, or t
ggttcgcgggtcaagccggccctatgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattannnnn

SEQ ID NO: 359042 - DNA, 2007 bp, Homo sapiens
  misc_feature (2003)..(2007): n is a, c, g, or t
ggttcgcgggtcaagccggccctatgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcggaggaagctggcccagttgcaggtggcctatcaccagctcttccaagaatacgacaaccacatcaagagcagcgtggtgggcagtgagcggaagcgagcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattannnnn

SEQ ID NO: 359043 - DNA, 2172 bp, Homo sapiens
  misc_feature (2168)..(2172): n is a, c, g, or t
aggagatagcaggcggtcccggttgtaatttcatcacgcagggacgaggagttgcagggtgtaaccatgtagctggccgatgggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattannnnn

SEQ ID NO: 359044 - DNA, 1336 bp, Homo sapiens
ggttcgcgggtcaagccggccctatgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcggcccgggcggccacgcagccggccccggccgctgcaccgtgcgcgcgagcgctgcgacacccccaccccgcgctcgtgcacccacctgacatcagggccccaaccgtggacggtcggccccggcatgacgagtcagggccgcctgcgcaccaagggaagcggcccaatcgccgcgcccatccccgtccagcatcgcaccacttcgcacccgcggccgacggccccgccgcctgatatcaacccccgcgccgccccggccaccggccaaccaccgaggcccatcacacgcacccatcacgccccgcaccccgtacccgccccacaccagacaacaccccgaaaccccccccccaccccccccacg

SEQ ID NO: 359045 - DNA, 1587 bp, Homo sapiens
ggttcgcgggtcaagccggccctatgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcggcccgggcggactctctgaagccctgcgctcctggcacttgactccaagcagccctctggagccagcacccctcagggaggccggccagacctcagggggacacggcaggagaatcgagctgggggagaggcccaggatcccggaccacagccgtgacaacgactggcccttggaagctctgcatcatcgtcgccagagccaccgccagatcatcatcaaccacagaccgacagaagatggtccagaagctggcacagacagaggatgcggccctggacagcctggagcggctggcgaccacgcatcgctccaggctcgggccggaaacaggacaggcaggggccgaagacaagtgatcgaacaccaagcgcaggtgccacctgggagatccccaaacccggcagcacagacaccagggccgaaggacctcggggcagaactcccacgccaccgccgcacgagggggtgggccagcacagaggaaaacgcacggcgaagaggcgccggggcacacgcccaagagcggcgcaggaccgaggcaaagagcacacacagcaggcacacggagcgtgaccaccgagacgagcgtcacgcaccacaccacggcagcagca

SEQ ID NO: 359046 - DNA, 711 bp, Homo sapiens
aggagatagcaggcggtcccggttgtaatttcatcacgcagggacgaggagttgcagggtgtaaccatgtagctggccgatgggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgaggaatgtgggtgccggcaggacaggcgattggtggctatggaccgccccctgcaggaagaggagccccca

SEQ ID NO: 359047 - DNA, 2109 bp, Homo sapiens
  misc_feature (1)..(1): n is a, c, g, or t
  misc_feature (2105)..(2109): n is a, c, g, or t
nagcccgttcctgctccgcgcttctggagcactggccaaggcgggccgattcaggacccaggttacttgggcggcgagctggactgtttctactcctccctcctcctccactgcggggtctgaccctactccttgtgtgaggactcctctagttcagagacatattctgttcaccaaacttgactgcgctctatcgaggtcgttaaattcttcggaaatgcctcacatatagtttggcagctagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattannnnn

SEQ ID NO: 359048 - DNA, 2076 bp, Homo sapiens
  misc_feature (2072)..(2076): n is a, c, g, or t
gtcctgaacgcccatcaagcccatggcccttgtgatccaggtggggaaactaaggcccagagaagtgaggaccccgcagactatcaatcccagtctcttcccctcactccctgtgaagctctccagcatcatcgaggtcccatcaggtggggaaggatgctgttccaggcgcacactagtctacaaggccagagctttctggaagggggcacccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattannnnn

SEQ ID NO: 359049 - DNA, 2304 bp, Homo sapiens
  misc_feature (2300)..(2304): n is a, c, g, or t
ggttcgcgggtcaagccggccctatgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattannnnn

SEQ ID NO: 359050 - DNA, 2171 bp, Homo sapiens
  misc_feature (2167)..(2171): n is a, c, g, or t
ggttcgcgggtcaagccggccctatgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattannnnn

SEQ ID NO: 359051 - DNA, 1508 bp, Homo sapiens
  misc_feature (1504)..(1508): n is a, c, g, or t
gtgcacctctgaccaggtggcagagtggaaggactgagggctctcagctgagctgtgcacatggcgggcacaggaccggctggctgtgagtgggtgtggcctgtggcctgtgaagggtgggaggagggctgtggagctggggattctgggaagggaatgtcggcccagctgggaggttgtaccagatgacctcagcggcctcttcagtcctgaaaaaaacctcagcatctcctctgtcgttttgggccgtgacaggacgcagccatctccctgtgcacgctgagatcctgcaatgggccctcaaatcaggggctggcatcacccagcctggtcagccagggccactctttcatccttctcagttcttctcagccagcctcgccctgggctgacgaggctccgtcagctccccttgcccgtccttagggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattannnnn

SEQ ID NO: 359052 - DNA, 1275 bp, Homo sapiens
  misc_feature (1224)..(1224): n is a, c, g, or t
ggttcgcgggtcaagccggccctatgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcggaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccagcggatatctanaagcggacttcaagctgagagcaggccgggaaaactggcgaaaaaaagagc

SEQ ID NO: 359053 - DNA, 426 bp, Homo sapiens
ctctgctccagccacactggcctcgctcttcctttagcataccacatgtgctttgccttggtggcttcttctgcctgtactgctcttcctccagatattcaaatggcttactctttgacctcctttgagtgtttgttcaaatgcctctatctcaattaggccactttgatcacccatttaattacaacccacacctcacaggtaatccccagccctcttaccctgttttcttcatagcactcatactgtactatactatgtaatttacctatttattatgcttcctatcaagtttctttctcctaggatgtaagctaatgaaagcagagattattgtctcatttcctggtgtacccccagcacctagaacactgtttggcacatggtagaggctcaataaacatttgttgggcgaatacatgaacg

SEQ ID NO: 359054 - DNA, 3226 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359055 - DNA, 979 bp, Homo sapiens
  misc_feature (29)..(29): n is a, c, g, or t
  misc_feature (876)..(876): n is a, c, g, or t
  misc_feature (884)..(886): n is a, c, g, or t
  misc_feature (893)..(893): n is a, c, g, or t
  misc_feature (897)..(897): n is a, c, g, or t
  misc_feature (905)..(905): n is a, c, g, or t
  misc_feature (910)..(910): n is a, c, g, or t
  misc_feature (914)..(914): n is a, c, g, or t
  misc_feature (921)..(921): n is a, c, g, or t
  misc_feature (928)..(928): n is a, c, g, or t
ccggctaggtacgaggctcgggtggtgcnaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcagttggnaagccggnnngggagtncccnggggcccncttgngacnagtctgngaagggnctggggaacctagaggggagaggggcaggggggccgaatgcccggggggaa

SEQ ID NO: 359056 - DNA, 4401 bp, Homo sapiens
  misc_feature (1)..(1): n is a, c, g, or t
  misc_feature (900)..(900): n is a, c, g, or t
  misc_feature (945)..(945): n is a, c, g, or t
  misc_feature (1277)..(1277): n is a, c, g, or t
nctcagtgcttaggcagtggcctgtgttttagacctggtgatgacagctcccctcacctaggagctgagcaccccggccatcttggtgaccacagagcaggtcacaggcttcagctgtacgccctgggcaggggagagattgtgctgcattcccagtctgctccacctcctggtgaggtctgtcaggcctggtcctgtccttggagccaccagcatcctcagacaagaatctagacagtgttgccagttccatccccaggatgcttgctcaaagccaatgcatggtctgagctccatgccaggccctggtgggggcagccacgttgacaccttcaccctgtccctcctcacccagcacatcctttactgcattgtggacagcgagtgtaagtcaagggatgtgctccagagttactttgacctcctgggggagctgatgaagttcaacgttgatgcattcaagagattcaataaatatatcaacaccgatgcaaaggtaaagttaacccagggctctgtggagtgtgctgggttgtccagaagttcacctggagtcctggtctgccaggctttaggcacaggttttacgttagagacgacgggggagtctgggcagtctttggcaaacattcattggaacctgctctgtctggctttgtgctagaccctgggaatgcagggatgaaaaccggggctgcttgtgggtagggagtgagggtgggaatgggtggcttgtgcgcctgccgtgacgcagcatggtgggtgccacggtgggagccgctgtagggagggactgggcctggtgtgttaggctcaccgagtgtgtgtgacagaaacccagctcaggctagctgaagtaaaattaaaagtaaaaattaaaggaatccagcacccttgagngtaaaaccactggagagagtgtcggatctgtgctgaattccgggnagtgcctcttagtacctgggtggtgaggggaggtccctcagcttatctgagcctctgtcttcctatctgaagcagtggggctggtagaggtcgctgatgccccttgtagtgactgtccccccgggccatggccatacctggccagcagcccactgcctgctgtgagcttggtttctgtatagttccaggtattcctgaagcagatcaacagctccctggtggactccaacatgctggtgcgctgtgtcactctgtccctggaccgatttgaaaaccaggtggatatgaaaggtacatgaaaggcaggctgtcaaggcaagtcatgcagggtnagaatgctggcatcagacaccctgtctccagcagggagacaagaatgactgagggagctgcaccagatgcccacgtggccggcctcaaggtggcggcttccagggcaattggctttgctgccttgttcaacactttaataaggtgaaaatccattgttgctagcaagatgcaaagaaaaccagaaaaagaccttcctcttctgggctggtattgcctggcacgatgagttggccccctcgtcctcagtgtgctgtgcgtggcatcgcaggtgccctgtggtgcagcaggcatctgaaccctcctggacttgctaacgcacttccatgtgtatgcgcacgcgtttcctttttttcctaggagagggcttgtggcatccagcagattctcctgagggtttgtgacccccccacacccccaaaaagtcaggcacttgttccttgtcacggtcactgtcattgatagcaagaagtatcccggttgttggtaatttagccgtttgcttcctttttctgccccagagggtctgtttcaggggaacagccacacagattttggtaccttcggttattgccctgcctcccagttgtgcgggaagcagttgctccgacactagtggacggagcagaacctgtgccttgtggtctcagcactgggccggactcacctgagagctggtgtggaaaaccagttgcgctaggacctctgcagaaggagtggaacttttgcgttgtttttcttaatgcagcgtcatggatccatcttcctgtggagggaactcttctgtgtgtgatatggagggcacgggtctggagccagtctggggagggctgagggagagctgccctgagcttggttctggaggatgaggtggggtgctcctgggcactctgagaacatggctttgcctggtagcaggacagctggaggtccttctttctgccacagtcagctttcgttgaagctgttttgatgatgagctcccagcttcagagtcaggacccaagcggggctccacgaaaggcctgggcgacccagccactgggcctaagcctgacctgctgcacccctgcctccctccacagttgccgaggtactgtctgaatgccgcctgctcgcctacatatcccaggtgcccacgcagatgtccttcctcttccgcctcatcaacatcatccacgtgcagacgctgacccaggtgagaggccccggcagacacacagcagggaaggtcgattggaaaccacttcctttgtcctggtgcccagcaggtttctgtcccccactccagaagtgcgtctctggagacccagctcttctgaggactgtgctcaggaggaatcagtgtcccattgtacagacagggcctaaggaaggagggctcgcaagtgccctcaggtcacaggctgacttgcaggccagtgctctccccgcctcccccatgtccacgtccctcacaccttctgccctgctgggctttggaatcggacctgaggctgcccaactccctcactgaatagtcatgcagccttcccttctctgagcctcctgcccctcttttctagagtgagggtgatcttagcacctctcagaggtggtctttggttccgttctgaggtgaagcaccaggtgggagtgcatggtgagtggggcagaactctttccccaccgaggcgcgcaggctagtgctgaatggcacttctgaagcgggataaccgccccaacacacgcacccagccctgcctgggacggaccttccggaaggagtgatgcttgagcccaggtctggacagggacaggtgttgttgcctcaggtggggtgggaggtgggcgtggggaagaggaaggtgctcagtcaggaaactggggctgctgggggcccccttcccccagtcctatctcacctctgtgcagggagagctctgtgggtggcccgaggcctggggccactctcctccctgcctgatggctacccaggttcaccaggggccactggggctcccaccagcccctgaccctgtgggcctgtggccttgcaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359057 - DNA, 2877 bp, Homo sapiens
  misc_feature (5)..(5): n is a, c, g, or t
  misc_feature (25)..(25): n is a, c, g, or t
aacanaagacaaagacggctaggtncgaggcctgggtggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359058 - DNA, 3059 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359059 - DNA, 3742 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggtaagcaggagacccccggggacagatggggcctcactggcttggagtagttgtttcaagacctgctgctgaccctttgaccttttttcctttgggagtagagcagaaactaaaatcatatcttatagtcccctaattggaagctaccttggagtaggatctgagtgaactccactccccaccccaacctatgcagaaatcccttttaagatcttcctaggctgggcacagtgactcggcctcccaaagtgctgtgattacaggtgtaaccaccacgccccgccttattttttattgagtgtgatggcatgtttttagcaggaagggggccacattagcttaatctgctgttgatcagatgtggaagtgaacagatggttttctaactaaagaaaagtcctcatggtacatgaggacagaggcttagagaagcaggctcccaccagagtgtctgcttgtgttattttggaaccttgtggctgtggtcctaacattgaggctgtgcatgtgtttcaggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359060 - DNA, 2340 bp, Homo sapiens
gcctactactactactactactactaaattagcggccgctcgacccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359061 - DNA, 4935 bp, Homo sapiens
  misc_feature (2067)..(2067): n is a, c, g, or t
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaaggtacatgaaaggcaggctgtcaaggcaagtcatgcagggtnagaatgctggcatcagacaccctgtctccagcagggagacaagaatgactgagggagctgcaccagatgcccacgtggccggcctcaaggtggcggcttccagggcaattggctttgctgccttgttcaacactttaataaggtgaaaatccattgttgctagcaagatgcaaagaaaaccagaaaaagaccttcctcttctgggctggtattgcctggcacgatgagttggccccctcgtcctcagtgtgctgtgcgtggcatcgcaggtgccctgtggtgcagcaggcatctgaaccctcctggacttgctaacgcacttccatgtgtatgcgcacgcgtttcctttttttcctaggagagggcttgtggcatccagcagattctcctgagggtttgtgacccccccacacccccaaaaagtcaggcacttgttccttgtcacggtcactgtcattgatagcaagaagtatcccggttgttggtaatttagccgtttgcttcctttttctgccccagagggtctgtttcaggggaacagccacacagattttggtaccttcggttattgccctgcctcccagttgtgcgggaagcagttgctccgacactagtggacggagcagaacctgtgccttgtggtctcagcactgggccggactcacctgagagctggtgtggaaaaccagttgcgctaggacctctgcagaaggagtggaacttttgcgttgtttttcttaatgcagcgtcatggatccatcttcctgtggagggaactcttctgtgtgtgatatggagggcacgggtctggagccagtctggggagggctgagggagagctgccctgagcttggttctggaggatgaggtggggtgctcctgggcactctgagaacatggctttgcctggtagcaggacagctggaggtccttctttctgccacagtcagctttcgttgaagctgttttgatgatgagctcccagcttcagagtcaggacccaagcggggctccacgaaaggcctgggcgacccagccactgggcctaagcctgacctgctgcacccctgcctccctccacagttgccgaggtactgtctgaatgccgcctgctcgcctacatatcccaggtgcccacgcagatgtccttcctcttccgcctcatcaacatcatccacgtgcagacgctgacccaggtgagaggccccggcagacacacagcagggaaggtcgattggaaaccacttcctttgtcctggtgcccagcaggtttctgtcccccactccagaagtgcgtctctggagacccagctcttctgaggactgtgctcaggaggaatcagtgtcccattgtacagacagggcctaaggaaggagggctcgcaagtgccctcaggtcacaggctgacttgcaggccagtgctctccccgcctcccccatgtccacgtccctcacaccttctgccctgctgggctttggaatcggacctgaggctgcccaactccctcactgaatagtcatgcagccttcccttctctgagcctcctgcccctcttttctagagtgagggtgatcttagcacctctcagaggtggtctttggttccgttctgaggtgaagcaccaggtgggagtgcatggtgagtggggcagaactctttccccaccgaggcgcgcaggctagtgctgaatggcacttctgaagcgggataaccgccccaacacacgcacccagccctgcctgggacggaccttccggaaggagtgatgcttgagcccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359062 - DNA, 2985 bp, Homo sapiens
agggccatttgcgacttgaagagcggtccccataatttgctgtcatacatctgcctgggcacttcctgggggtctggttggtggcaggagaagggcataagcagggagggatgggtcatgttactgtattggctgtgtccgaatatttttactttatgttaaagttgatgaggcacaactattgcagagtccatttttccgagtctctgcgctcacctggctcctgggattgtggagggagttttgcagctttcagagtctgtgttttgggctcatggcccagccgaatggccatgctacaagtctgttcagagcaggttcgaggggcagaaacgtgtttcctcacaagctgtgactcaatcctgtctccggtggctgtgtcagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggtaagcaggagacccccggggacagatggggcctcactggcttggagtagttgtttcaagacctgctgctgaccctttgaccttttttcctttgggagtagagcagaaactaaaatcatatcttatagtcccctaattggaagctaccttggagtaggatctgagtgaactccactccccaccccaacctatgcagaaatcccttttaagatcttcctaggctgggcacagtgactcggcctcccaaagtgctgtgattacaggtgtaaccaccacgccccgccttattttttattgagtgtgatggcatgtttttagcaggaagggggccacattagcttaatctgctgttgatcagatgtggaagtgaacagatggttttctaactaaagaaaagtcctcatggtacatgaggacagaggcttagagaagcaggctcccaccagagtgtctgcttgtgttattttggaaccttgtggctgtggtcctaacattgaggctgtgcatgtgtttcaggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359063 - DNA, 2884 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359064 - DNA, 3552 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatgacaaaaaaaaaaaaaaaaaaaaaaaaaaaaatttgtgggcggccggggccgaaaaaatttttaagaaccttccgctcgtggggggggcgggggcccccaagaggtgttaaggtttgcacactggcgcccaaagcagggctccagaggaaaaatcgtggcccaagagacacagagtgccgggtttctccccccaataaaaaaaagggcgcggggggaccaccggaggtgtttcgtgaacaaaattcccgaagggggctccgggaggccacatacgggctctactcaaagggagtccacagagaactcaaaataaatgagccgacgggg

SEQ ID NO: 359065 - DNA, 3130 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccagcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359066 - DNA, 2761 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtggctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359067 - DNA, 2456 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacgccgctcctgcctgagcctggacatggggcccttccttgtgttgccaatttattaacagcaaataaaccaattaaatggagactattaaataactttattttaaaaatga

SEQ ID NO: 359068 - DNA, 2093 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactccgtactggcccgcgggccagtacggatgtggagaagatggaaactgcaggagatgcagctgaaggaggccaagcacatcgctgaggattcagaccgcaaatatgaa

SEQ ID NO: 359069 - DNA, 253 bp, Homo sapiens
ttaaatggagactattaaataactttattttaaaaatgactgctgtggacctggcttttgtccctaggactgtgtttttcctcctgaaccccaaagaaaagaatgagaaggaaactggctgtggtgtttattcagggcccagggaaggctgaaggcagcagggggcgatgcagagatggcaggatcggggcaggtggcctcagccagatgtgcaacagcagacattcctctttagagcccagggggtcaggcc

SEQ ID NO: 359070 - DNA, 449 bp, Homo sapiens
cccaggactcttgcatcccaaaggactcttgaatcatatgcaggactctctgaatcccaaactcatgcttctgtgataggaactaccggacattatgccttgtaggattattgtgagcattaatgagcaaagttagaaagtgggtttgtgtgtgctgggcataggggatacacggatgttttcttcagaccctggccctccttactgacagtactgatacttgtcctgaatatcattatcgtgtgtactgagcacgaggttttgctagatttttcaagcacatttgtcttaatactttttccttcctatcccattcaggttcacagaatgattgcagagttcaagctgatccctggacttaataatttgtttgacaaactgatttggaggaagcattcagcatctgcccttgtcctccatggtcacaaccagaactgtgactgtagccc

SEQ ID NO: 359071 - DNA, 443 bp, Homo sapiens
agcataataagaaaacagctgctgtatcaaaccaaaagcaatatgcaaatgggcttgtaggttctgatgggcactatgaaaacctttggtagacaggggctggaagaagtatattaaaggaaaaataatcatcttggaggggattataacagttcttatgctgaaaaaaatgtggtaactgttgtactatcttttcattgagaaaaataaccagtcattaccctttcactttcagtaagtgatgaaatgtccaaggactgcttgagtatcctgtataatacctgtgtctgtgtaagtacccctgccactggggctctgtttatctcccctaccaggtctgcaatgtttaagatgggaatattcgagtagaatggcagacataagagctgctttcagacagtgggggaatcgggcttattttatgtgtgcctgaaaatcaggac

SEQ ID NO: 359072 - DNA, 502 bp, Homo sapiens
gcctactactactactactactactaaattagcggccgctcgacccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgccgctcctgcctgagcctggacatggggcccttccttgtgttgccaatttattaacagcaaataaaccaattaaatggagactattaaataactttattttaaaaatga

SEQ ID NO: 359073 - DNA, 780 bp, Homo sapiens
gatacatctaagatgagtcttgaagtcagtggacaggtagagttccatcagggccgggcgtgagctgtcaggaggcttcatgcccacatgggcctttgtcacttcagtgccttgtccaaactccctgtcgtggatacccgctgtgccctctgggtccctcggtcagcatcaaccactacttccctaggccagcccatcgtctgtgagcccagtggcctgtctgcatgtgttcgtccgcttcccacacacattcctggcccctcaattgcacgtcctcccattcttgtgaaagggcaaggcctagagtatgtttcacgggggctcgcaggagccagcccttcgatcccagatgttaccctttctgtgacacagccccttccagacagacccagatagaagacttctccactgagctggctctctgtgaggatgggggcactgctgtgtccccaggcccaggatgaagcctgatgcttggtagatgttcagtaaatgttgagtacatgaaaaggcaacaaacatctcccaaccccttggagaactgaacatgggccggaagagggcagccttagccacctgagccagtatttgggtcgcaggttttggcaagctcgggctgtggagagtttcctccgagggaccacctcctatgcagaccagatgttcctgctgaagcgaggcctcttggaggtatgatctggagcagccagtgtcttgggttccgtctccccccagcccacgcgttgctgtgtcctgtcctgagccccaaacagttcatca

SEQ ID NO: 359074 - DNA, 3202 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359075 - DNA, 2412 bp, Homo sapiens
  misc_feature (29)..(29): n is a, c, g, or t
ccggctaggtacgaggctcgggtggtgcnaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359076 - DNA, 5191 bp, Homo sapiens
  misc_feature (2067)..(2067): n is a, c, g, or t
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaaggtacatgaaaggcaggctgtcaaggcaagtcatgcagggtnagaatgctggcatcagacaccctgtctccagcagggagacaagaatgactgagggagctgcaccagatgcccacgtggccggcctcaaggtggcggcttccagggcaattggctttgctgccttgttcaacactttaataaggtgaaaatccattgttgctagcaagatgcaaagaaaaccagaaaaagaccttcctcttctgggctggtattgcctggcacgatgagttggccccctcgtcctcagtgtgctgtgcgtggcatcgcaggtgccctgtggtgcagcaggcatctgaaccctcctggacttgctaacgcacttccatgtgtatgcgcacgcgtttcctttttttcctaggagagggcttgtggcatccagcagattctcctgagggtttgtgacccccccacacccccaaaaagtcaggcacttgttccttgtcacggtcactgtcattgatagcaagaagtatcccggttgttggtaatttagccgtttgcttcctttttctgccccagagggtctgtttcaggggaacagccacacagattttggtaccttcggttattgccctgcctcccagttgtgcgggaagcagttgctccgacactagtggacggagcagaacctgtgccttgtggtctcagcactgggccggactcacctgagagctggtgtggaaaaccagttgcgctaggacctctgcagaaggagtggaacttttgcgttgtttttcttaatgcagcgtcatggatccatcttcctgtggagggaactcttctgtgtgtgatatggagggcacgggtctggagccagtctggggagggctgagggagagctgccctgagcttggttctggaggatgaggtggggtgctcctgggcactctgagaacatggctttgcctggtagcaggacagctggaggtccttctttctgccacagtcagctttcgttgaagctgttttgatgatgagctcccagcttcagagtcaggacccaagcggggctccacgaaaggcctgggcgacccagccactgggcctaagcctgacctgctgcacccctgcctccctccacagttgccgaggtactgtctgaatgccgcctgctcgcctacatatcccaggtgcccacgcagatgtccttcctcttccgcctcatcaacatcatccacgtgcagacgctgacccaggtgagaggccccggcagacacacagcagggaaggtcgattggaaaccacttcctttgtcctggtgcccagcaggtttctgtcccccactccagaagtgcgtctctggagacccagctcttctgaggactgtgctcaggaggaatcagtgtcccattgtacagacagggcctaaggaaggagggctcgcaagtgccctcaggtcacaggctgacttgcaggccagtgctctccccgcctcccccatgtccacgtccctcacaccttctgccctgctgggctttggaatcggacctgaggctgcccaactccctcactgaatagtcatgcagccttcccttctctgagcctcctgcccctcttttctagagtgagggtgatcttagcacctctcagaggtggtctttggttccgttctgaggtgaagcaccaggtgggagtgcatggtgagtggggcagaactctttccccaccgaggcgcgcaggctagtgctgaatggcacttctgaagcgggataaccgccccaacacacgcacccagccctgcctgggacggaccttccggaaggagtgatgcttgagcccaggtctggacagggacaggtgttgttgcctcaggtggggtgggaggtgggcgtggggaagaggaaggtgctcagtcaggaaactggggctgctgggggcccccttcccccagtcctatctcacctctgtgcagggagagctctgtgggtggcccgaggcctggggccactctcctccctgcctgatggctacccaggttcaccaggggccactggggctcccaccagcccctgaccctgtgggcctgtggccttgcaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359077 - DNA, 3857 bp, Homo sapiens
  misc_feature (2321)..(2321): n is a, c, g, or t
  misc_feature (2366)..(2366): n is a, c, g, or t
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaaggtaaagttaacccagggctctgtggagtgtgctgggttgtccagaagttcacctggagtcctggtctgccaggctttaggcacaggttttacgttagagacgacgggggagtctgggcagtctttggcaaacattcattggaacctgctctgtctggctttgtgctagaccctgggaatgcagggatgaaaaccggggctgcttgtgggtagggagtgagggtgggaatgggtggcttgtgcgcctgccgtgacgcagcatggtgggtgccacggtgggagccgctgtagggagggactgggcctggtgtgttaggctcaccgagtgtgtgtgacagaaacccagctcaggctagctgaagtaaaattaaaagtaaaaattaaaggaatccagcacccttgagngtaaaaccactggagagagtgtcggatctgtgctgaattccgggnagtgcctcttagtacctgggtggtgaggggaggtccctcagcttatctgagcctctgtcttcctatctgaagcagtggggctggtagaggtcgctgatgccccttgtagtgactgtccccccgggccatggccatacctggccagcagcccactgcctgctgtgagcttggtttctgtatagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359078 - DNA, 3582 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatgaaaaaaaaaaaaaaaaaaaacaaagaacaaacaaaaaaaaaaaaaaaaaaaaaaaaaaaaatttgtgggcggccggggccgaaaaaatttttaagaaccttccgctcgtggggggggcgggggcccccaagaggtgttaaggtttgcacactggcgcccaaagcagggctccagaggaaaaatcgtggcccaagagacacagagtgccgggtttctccccccaataaaaaaaagggcgcggggggaccaccggaggtgtttcgtgaacaaaattcccgaagggggctccgggaggccacatacgggctctactcaaagggagtccacagagaactcaaaataaatgagccgacgggg

SEQ ID NO: 359079 - DNA, 3559 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatgactgctgtggacctggcttttgtccctaggactgtgtttttcctcctgaacttggggcccagggcgtcccgggtccgtgcccgcagcttgttggcctgggtttccgccatgtctgcccgctcctccgcatcatccagctcgtgctgggccttgcgatacttggccaggttggtgttggcctgctgctcctgggggcacacacagggccttggttccgcttgggtgactgagatgcttattctggtccctgccccagtccaagaagggagctagctcctcctggttctcaactttgttcctattgccactgtccatcctcaccaataccacagcg

SEQ ID NO: 359080 - DNA, 2853 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcagcctgcccctctgcctcattttcctgtagctcctctggttctgtttgctcattggctgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 359081 - DNA, 2420 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacgccgctcctgcctgagcctggacatggggcccttccttgtgttgccaatttattaacagcaaataaaccaattaaatggagactattaaataactttattttaaaaatga

SEQ ID NO: 359082 - DNA, 1763 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttatatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggtaagcaggagacccccggggacagatggggcctcactggcttggagtagttgtttcaagacctgctgctgaccctttgaccttttttctttgggaggccgagcgggcagatcacttgaggtcaagagttacagaccagcctggccaacatggtgaaaccctgtctcactagtgtgagagacacttgcgtctctcactaaaaatacaaaaattggccaggtatggtgttgggtgcctgtaatcccaactcttcgggaggctgaggcaccagaattgcttgaacccaggaggcagaggttgcagtgagctgagatcacgccact

SEQ ID NO: 359083 - DNA, 621 bp, Homo sapiens
cgcagacatcaaagtaccttacagaaggaccagttcccatccgcagacgtgaggacctgggcgatggccaaaggcttagtccaacacccaccggggccgcagagtccgagctggccttccccagcttcctcctgcaatgcttcctgggggccctgtggctggctctgagtggcaccctattctccacacctggccccctcagagccagctcccattcactgcaggacccagtacacacagagaaaattccagaagagccgccagccccgccccagctcccagtataaccagagactctttgggggagacatggagaagtttatccagcaacaatttgcaaatacaacgtaaggcactgcctaaaacctcatcaaaaatatcagacacctacgagtggatctaacaaacggtgtgctaagcctctgtgccgacaacgatgatgtgttcttcagagaaaataaaagcactcagcctggtgcggtggctcatgcctgtaatcccaccattggggagcttgaggcaggagtatcacttgagcccaggaagctgaggctacagtgagccgagatcacgccagtgcacttcagcctgggtgacagagtgagaccttgtctcaaaaaa

SEQ ID NO: 359084 - DNA, 3886 bp, Homo sapiens
cgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggcctgcagcatgaaggcatcttccgggtatcgggtgcccagctccgggtctcagagatccgtgatgccttcgagagaggggaggacccactggtggagggctgcactgcccacgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaggggaggcagaaaaaaaactcagagggggggaaccacaaaaaagagcacaagaaacgacaacaggagaccaaaaagaagagaaaacaaagacggacggagagcaaaacaaacagacacacggaaaaacacgaaaggacacacacgagagaaaacccacaagggggagacaaaaaagaacaaacaccgaacaaaaaaagccccgagcatcaaacaaaagagcacaaagggcaaacaccgaaacataccgacgacgaagagcgtccggcaggggacaatgaaaatatacccgggggcaaactataaacgagacgacagaaagcacgggagacagacgcgcggaacagcgaggcacgaccaaagcgcagaacagaagagagaagagcggaccaagcacagaccagacaacggcgagccaggacaaacagagacagagcaaggacaacaagaacgagggagcaagggagacgaagaagagcgaaagagcaagccgaataagcaaaaaccaaaccaaagaaaagagaagagacaaaggaaagaagctaaaggacagtcaa

SEQ ID NO: 359085 - DNA, 3374 bp, Homo sapiens
cgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggggaggacccactggtggagggctgcactgcccacgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccgatgggagccagctctctgtctcgggtgggcaggtgggtgctggaggtgagaacagcttccccaggggtcctgcagctttgaagacttggctgcctgcgccatggattccagagctgtgcacgtgactgtgggtgtgtgtggggagtctgtgtatgtctctgtgctgcctccacacccaccgttacccggatccaaggagaccccttgccatgtggaa

SEQ ID NO: 359086 - DNA, 3391 bp, Homo sapiens
cgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccaggcctgcagcatgaaggcatcttccgggtatcgggtgcccagctccgggtctcagagatccgtgatgccttcgagagaggggaggacccactggtggagggctgcactgcccacgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccgatgggagccagctctctgtctcgggtgggcaggtgggtgctggaggtgagaacagcttccccaggggtcctgcagctttgaagacttggctgcctgcgccatggattccagagctgtgcacgtgactgtgggtgtgtgtggggagtctgtgtatgtctctgtgctgcctccacacccaccgttacccggatccaaggagaccccttgccatgtggaa

SEQ ID NO: 359087 - DNA, 1120 bp, Homo sapiens
gaaggtctgggctgggccagagaacagagcctctctgaccactcctggctggcgcggaggctgctggccctggaccccgtgcagggaaggagcactcgaaacaggccggtccttcccaccgcaggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccgatgggagccagctctctgtctcgggtgggcaggtgggtgctggaggtgagaacagcttccccaggggtcctgcagctttgaagacttggctgcctgcgccatggattccagagctgtgcacgtgactgtgggtgtgtgtggggagtctgtgtatgtctctgtgctgcctccacacccaccgttacccggatccaaggagaccccttgccatgtggaa

SEQ ID NO: 359088 - DNA, 1878 bp, Homo sapiens
cgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagcaacaatttgcaaatacaacgtaaggcactgcctaaaacctcatcaaaaatatcagacacctacgagtggatctaacaaacggtgtgctaagcctctgtgccgacaacgatgatgtgttcttcagagaaaataaaagcactcagcctggtgcggtggctcatgcctgtaatcccaccattggggagcttgaggcaggagtatcacttgagcccaggaagctgaggctacagtgagccgagatcacgccagtgcacttcagcctgggtgacagagtgagaccttgtctcaaaaaa

SEQ ID NO: 359089 - DNA, 273 bp, Homo sapiens
agtcctccctgagggctggggccctgcgacggtccgccatctcttctcttcctggggcccagctcagctgcccaatcccctgggcctcacttccccagttttcgcactggattgtggaataacttcagagaattagaggccggcttggctggcctggggggtggggcaccctattctccacacctggccccctcagagccagctcccattcactgcaggacccagtacacacagagaaaattccagaagagccgccagccccgccccagctcc

SEQ ID NO: 359090 - DNA, 362 bp, Homo sapiens
cccagcttgagttttgaaatgttacttgattcaagattggtgtacagaattcaattgcatttgtatattccagcaacaatttgcaaatacaacgtaaggcactgcctaaaacctcatcaaaaatatcagacacctacgagtggatctaacaaacggtgtgctaagcctctgtgccgacaacgatgatgtgttcttcagagaaaataaaagcactcagcctggtgcggtggctcatgcctgtaatcccaccattggggagcttgaggcaggagtatcacttgagcccaggaagctgaggctacagtgagccgagatcacgccagtgcacttcagcctgggtgacagagtgagaccttgtctca

SEQ ID NO: 359091 - DNA, 878 bp, Homo sapiens
tcagcacgtctctgtgtcagagggtccatggcctcaggtgaggtgcatggctctggccggtggagggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccgatgggagccagctctctgtctcgggtgggcaggtgggtgctggaggtgagaacagcttccccaggggtcctgcagctttgaagacttggctgcctgcgccatggattccagagctgtgcacgtgactgtgggtgtgtgtggggagtctgtgtatgtctctgtgctgcctccacacccaccgttacccggatccaaggagaccccttgccatgtggaa

SEQ ID NO: 359092 - DNA, 3452 bp, Homo sapiens
cgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggcctgcagcatgaaggcatcttccgggtatcgggtgcccagctccgggtctcagagatccgtgatgccttcgagagaggggaggacccactggtggagggctgcactgcccacgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccgatgggagccagctctctgtctcgggtgggcaggtgggtgctggaggtgagaacagcttccccaggggtcctgcagctttgaagacttggctgcctgcgccatggattccagagctgtgcacgtgactgtgggtgtgtgtggggagtctgtgtatgtctctgtgctgcctccacacccaccgttacccggatccaaggagaccccttgccatgtggaa

SEQ ID NO: 359093 - DNA, 3460 bp, Homo sapiens
tttgcaagggaggctgccacctcccggagcctgggtaccggcgggaaaggaagtcgcaggggaaaccattcagaggctttccaggaacgagggagagacaggaagccaaactgaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggcctgcagcatgaaggcatcttccgggtatcgggtgcccagctccgggtctcagagatccgtgatgccttcgagagaggggaggacccactggtggagggctgcactgcccacgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccgatgggagccagctctctgtctcgggtgggcaggtgggtgctggaggtgagaacagcttccccaggggtcctgcagctttgaagacttggctgcctgcgccatggattccagagctgtgcacgtgactgtgggtgtgtgtggggagtctgtgtatgtctctgtgctgcctccacacccaccgttacccggatccaaggagaccccttgccatgtggaa

SEQ ID NO: 359094 - DNA, 3537 bp, Homo sapiens
cgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggcctgcagcatgaaggcatcttccgggtatcgggtgcccagctccgggtctcagagatccgtgatgccttcgagagaggggaggacccactggtggagggctgcactgcccacgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctggggtacacccttggtgctgccgaggggactggggggtccactggagaagagcccccctcatctgcctcgctctgccctgaacctcagggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccgatgggagccagctctctgtctcgggtgggcaggtgggtgctggaggtgagaacagcttccccaggggtcctgcagctttgaagacttggctgcctgcgccatggattccagagctgtgcacgtgactgtgggtgtgtgtggggagtctgtgtatgtctctgtgctgcctccacacccaccgttacccggatccaaggagaccccttgccatgtggaa

SEQ ID NO: 359095 - DNA, 755 bp, Homo sapiens
ggggactcggggtgcgggctctctgcttgtgatgtgcgtgtccccccagctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccgatgggagccagctctctgtctcgggtgggcaggtgggtgctggaggtgagaacagcttccccaggggtcctgcagctttgaagacttggctgcctgcgccatggattccagagctgtgcacgtgactgtgggtgtgtgtggggagtctgtgtatgtctctgtgctgcctccacacccaccgttacccggatccaaggagaccccttgccatgtggaa

SEQ ID NO: 359096 - DNA, 644 bp, Homo sapiens
cgtgggagcagtggggttcgacggcgcggccgcgaggccgccatggccgctcacgggaagctgcggcgggagcgggggctgcaggctgagtatgagacgcaagtcaaaggtgagagggcgccgggcgctcccggcccgtttcctgcggagaacccaaggtcgtgagggagctccaagcgtccccgccgcctgagtcacattgcagaggacgtggggcgcctggtcaagaagctggaccgacagaccattgagacagaggaggtgaacaagactctgaaggcgacactgcaggccctgctggaggtggtggcctcggatgacggggatgtgcttgattccttccagaccagcccctccaccgagtccctcaagtccacgcctggcagggctgggtggcgattcataaagacctcgtgttgattccccgatgggagccagctctctgtctcgggtgggcaggtgggtgctggaggtgagaacagcttccccaggggtcctgcagctttgaagacttggctgcctgcgccatggattccagagctgtgcacgtgactgtgggtgtgtgtggggagtctgtgtatgtctctgtgctgcctccacacccaccgttacccggatccaaggagaccccttgccatgtggaa

SEQ ID NO: 359097 - DNA, 456 bp, Homo sapiens
tatttgtcttttcactgtgtgggtatttatactgattatacaatagcaattgtgggtaaaattgatggggacatagtacgaatcaaggcagtgaaattagacaatatagtagtcattagtcattatttatttgttgctatgcacatgagggaaaaaatggcaatttcactttagaataccttgatgaagcagtgaaaatgatttaagtttattgaattttgatcttgattacacatcttagtctgtgtgaaacaatgtgaagtatgcataaaacacttctgctgcatactaaagtgtactgattatctcaagaaaaagcatttgtcctattatttgagttgaaaactaacatttgcttttcttcataaaaattcacttacttgaaagaatgactgagaaacaaaccataactatttggcagatattttctcaaaactgaaagaaattccttttgct

SEQ ID NO: 359098 - DNA, 242 bp, Homo sapiens
agagtaagcctgggcctccaatcccagctatccctttccctttctttactggacctgggaccccagagtctgcctcaccccactcccctgtacctcctgccctcccggacaccctaggagtactcaacactcacccagtccttgtacctctttggactccggggataccagaatgtttcaggacacccctccctctggggtccactcttggcctagacattttgtgtccttggaggaagagc

SEQ ID NO: 359099 - DNA, 513 bp, Homo sapiens
atggtcatttgttacagtagcaacagagaacttacaaagcccccaatccagaaagtgtaggcttcctcactttcaacactgaccagtccacaggaaattcatacagaccaatattggcacccggagtctcctgaaaaatagccgatggccctccctgatcatcctatagtgaaatctcctttttaaaaactacactcatccacacagtgtctaaatctgaaatataaatgaacacctaaggatgagtcaacacttggaaaaagcttttgacatcaaagagatcccaacaaacacaaagagagaaggaattggatggaaaaagagacaatgccagtgaaaaatgactttaaaaacataattgagggtagctgtagtggcttacgcctgttatcccaactaatcagcaaggtgagatgggaggatggcctgaggctgagagtttgaagctacagtgagttatgatcatgtcactggactccaacctggacaaccgagtaaggctcatctctaaaa

SEQ ID NO: 359100 - DNA, 380 bp, Homo sapiens
ttttatagtatcttaaatatgaagtacttttcattagacaggggaacttgagagaatgttgtgtaatataatgttgtttgcctaccacaaacccatcctctaacccccatcctcttcttccttgctagaaaagtcctatttgttccatctcctttaggtagccaggtccttaagaggcaactgcatgcctctcaggtcctaagatgatcgtgtaaacatcattccccttatgtgattattttaggcataaatatgttgtcatgccataggcagtgactcatgtggccaatgttctttaaggggtagtcttctgaatgatttatgtgtagaatattcttactctttaaatggcagaactgccgggcgcggtggctcccgcc

SEQ ID NO: 359101 - DNA, 373 bp, Homo sapiens
acaaactcacaaaaaaactcttggtctgggacattataggcatgcagggggtaggaaagagacctcaatgagacctaacatgaagcaacagtaaagaatacatatgagtctgaatcttaagaatactggaacaaagtgagaggagggagttaggttaggcaattagacagggagggactcagcagaagagcaacagtaatagaaacgcctgcagaacagcagcaacaccacctctgcagctagcgggaagatcaacagtcataggaacacccgtgggacagcacccacactgcctctgcagctaaagggaagaaatgtagttaagaacttccccttatgccaggaggtctgctcagaagggactgtcccagct

SEQ ID NO: 359102 - DNA, 384 bp, Homo sapiens
cacctctcctcttggctctgcaagtctttgcatggaacagctgatttaacgtgggcccagggcagcaggggaccctaaagcaagcctcctgggtggggggaggcagtggcatgtcactgggactcccctgtcctgttggccttctgtggtggatttgggggccagtggcccgctgagggcaggacacaccctggcaagggagcgggcgtgggcgggagggcatgttgctgcagtctggggcatgtgagcttggcctccagagatgagctcatcctccctgggccttgctgagcgtctgaggcttcttcaccgaggctcacctgagtgacttcagcgccgggggtttaccaaggaaaaacgttcccctccagtttgaaaaaaaaa

SEQ ID NO: 359103 - DNA, 808 bp, Homo sapiens
caagcggacctaaggagtcgcagttgtgaacaggtttggtgccgcgggctggggtaggcggcggttgggtccgtggctctggggcactgggaagatcgcgagtcgtgcgcatgggaaggtcctcccccggtcctccgggtcatctttgctcccgaggagcggcatatttcgcatctgcctgaggtgtgcccgggggtcgttgggagagtgacgggatgaatccctgcagagagcccggactgggagggaaggtgtcggggagacgtcgtttcctggcgacgtggtcccggcaggcgacttagacctgagccgaatctgttgaccccaaattgtgcttttcccaccaagaagaaaagggagagaaacagtacaagttcggcagtaaaatatagtagagaagcaatatagcctctgaaatcacacagctattcagtttcaaagcgttcctagtgcccagctctcctaactcccggccagtgttccttgacatatggtgatatataaagactttctgtttccgctcgtgtgtgtgtctgtgagaagcctctgactcacttctgtgctccagtagcaccctctgcagccttgcaatgtagcccttattgcatggcacggaagatactagtttggatttcctctgccaatcagaccatagctatatccattttctggcacagtggctagcacatcatagacagacacaaacatttattaaacggaatgaatacaggaccttaactgaatgaaatggtaccctgccccgctttttctcaatcaagctgtcagattttatgcagcccgatattcc

SEQ ID NO: 359104 - DNA, 1303 bp, Homo sapiens
caagcggacctaaggagtcgcagttgtgaacaggtttggtgccgcgggctggggtaggcggcggttgggtccgtggctctggggcactgggaagatcgcgagtcgtgcgcatgggaaggtcctcccccggtcctccgggtcatctttgctcccgaggagcggcatatttcgcatctgcctgaggttagagttacttgttattggtaaatagccactatggagactaaggaccagaagaaacacagaaagaaaaacggtggacccaaagctgcaaagaaaaagaagtggcatctgcaggatctccagctaggagactaagaaaatgcccagaagagaaatgccaatgcttttgcagttcagtctgctgtgtggatgtctcgatcctttcacaggactctggatttgaagacacaaaagcatcatattccagtggttgatggaactccactagagccgccaccaataccggtagtggtgacggggcctccaaagttggaaagagcactttgatataatgcctcattcggaacttcacctggcagaagttcaccgagatcagaggccctgtgacgatcgtgtcaggtaaaaagcgcagactcaccattattgaatgtgggtgtgacattaacatgatgattgatctggctaaagtagcagatctggtactgatgcttatagatgccagctttgggtttgaaatggaaatgtttgagtttctaaacatctgtcaagcacatggctttcctaaaattctgggagttctcacccacctcgactccttcaagcataacaagcaactgaagaagacaaagaagcgattaaaacacaggttctggacagaagtttaccaggttgccaaactgttctacctttctggaatggtgcatggagaatatcaaaaccaagaaatccacaatctgggccattttattacagttatgaagtttaggcctctcatggcaaacttttcacccttatatcctggcagacaggatggaagatttgacaaacccggaggatatccaaacaaacatcaaatgtgaccggcaggtgtcactttatggttatttaagaggagcacacttcaaagataaaagccaaattcacatgccaggacaaggtggggctcacccatgagctggtccagagtctcatctccacctactccaccattgatgccaagatggcttcaagtcgagtgacgctgctttccaattccaaaccacttgggtcagaggctatagataatcaagggtaagtctgctttttttctatttttaataaaaagatatattacagaaga

SEQ ID NO: 359105 - DNA, 559 bp, Homo sapiens
ggaatgaatgtcactttcagcctagagacacagttgtgtgcctgccccttttcctctgctggatggtgaacggtgcttccttatttctgcattttctagttcctaagtgatgtgcttagtggacaagagtgtgatgagtcattgacacatgaaaggaggtataggaactttggcattcgtttctgctgtatgattgagtttatttttctaggatggaagatttgacaaacccggaggatatccaaacaaacatcaaatgtgaccggcaggtgtcactttatggttatttaagaggagcacacttcaaagataaaagccaaattcacatgccaggtattctcttgttgtagaacatactagaattgcacataggattcttgggatggcttcatttctcaggaaaaatgaaaaatgaccaaacaagggaagatggccttgctggaggttttaaaagtaagccagctatgtgtaggcctgcaaaggtgttaccgaatccctcttctctgacctcttgtagctagagggccactgttccagtgtggcacaatgcccttcttta

SEQ ID NO: 359106 - DNA, 460 bp, Homo sapiens
tttctctgtctgggtgatgcctgtgtagtcatttgatttagtctggagtgggacttttctgtcgagggccagatagtgaatattttcagctttgtggatcatatcttctgcagctacttagctctgcagttgtagtgcacaggcggccatagacaatatgtaaaggaattaatgtggctatgttccaataaaactttagttacaaacacaggtgatgggctggatttggcccgtgggccagttgccaacccctagtgtaggtggtctgttttggtagtttcttcgagaaataatgtgttgtgcttgtaggtactgatgcttatagatgccagctttgggtttgaaatggaaatgtttgagtttctaaacatctgtcaagcacatggctttcctaaaattctgggagttctcacccacctcgactccttcaagcataacaagcaactgaagaagacaaaga

SEQ ID NO: 359107 - DNA, 1153 bp, Homo sapiens
caagcggacctaaggagtcgcagttgtgaacaggttagagttacttgttattggtaaatagccactatggagactaaggaccagaagaaacacagaaagaaaaacggtggacccaaagctgcaaagaaaaagaagtggcatctgcaggatctccagctaggagactaagaaaatgcccagaagagaaatgccaatgcttttgcagttcagtctgctgtgtggatgtctcgatcctttcacaggactctggatttgaagacacaaaagcatcatattccagtggttgatggaactccactagagccgccaccaataccggtagtggtgacggggcctccaaagttggaaagagcactttgatataatgcctcattcggaacttcacctggcagaagttcaccgagatcagaggccctgtgacgatcgtgtcaggtaaaaagcgcagactcaccattattgaatgtgggtgtgacattaacatgatgattgatctggctaaagtagcagatctggtactgatgcttatagatgccagctttgggtttgaaatggaaatgtttgagtttctaaacatctgtcaagcacatggctttcctaaaattctgggagttctcacccacctcgactccttcaagcataacaagcaactgaagaagacaaagaagcgattaaaacacaggttctggacagaagtttaccaggttgccaaactgttctacctttctggaatggtgcatggagaatatcaaaaccaagaaatccacaatctgggccattttattacagttatgaagtttaggcctctcatggcaaacttttcacccttatatcctggcagacaggatggaagatttgacaaacccggaggatatccaaacaaacatcaaatgtgaccggcaggtgtcactttatggttatttaagaggagcacacttcaaagataaaagccaaattcacatgccaggacaaggtggggctcacccatgagctggtccagagtctcatctccacctactccaccattgatgccaagatggcttcaagtcgagtgacgctgctttccaattccaaaccacttgggtcagaggctatagataatcaagggtaagtctgctttttttctatttttaataaaaagatatattacagaaga

SEQ ID NO: 359108 - DNA, 1197 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359109 - DNA, 1241 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggacactgaggctcaaggcatttttatagacttgtctaagatctggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359110 - DNA, 745 bp, Homo sapiens
aactctgctatcgtagtactagagcagcataggccaaacacaagcaaatgtgactgttcagtaaaactttacagggggcagactggattttacccatagttcctagtttgccaacccctgatatagattatccctattatattctacttcatagatgaagaaattgaggcttagcaagcttaagtaacctgcccaaagtcacacagctgacaaataaggaagccagaatttataccaagctttgcctgactctggagctcatgctcttaacaattaactgtcatcacaagattagttttgtgttagtgtaacaatgtgactgatattaaatacgtctttttttatttgtttgtttggagctaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359111 - DNA, 1479 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatggtctcagaaatattccagtatatacaataaatcgcatagtcatcctgccttcacttgacaggagccaaacttccagcctgtcctacctgcctgcacatcaggattcctgtgtgcccctggatgcagccctacatgttgttttgtatttttggtccctcttgggtctacaaagttacttatcttgtttttgagtctttttgatgttaatctgcttataaggtatctattttaggtaggttagcctgagggagtacattgtaacacgaatttagtgcccctcctgtcaaaaggtctctgttttttccgaagcagaatgctttggaaacttgaggagtctttttatttgctgataatttggttaatatgcttgaactcagtgaaaacctcatttcagaaataaatatttataagtacttcactcaagtaattctatttatatattccctctccattccaaatgtttaaaagaggggttaatttaacttcaacacagtggaaaaaaataaatttataagaactaaattgtaataatattagagataaaagtaaacgtgtctgttgttaaataagaaattaattacaaattcatttagggtctttactataagtgaaaaactatatgtgtatagcaaaaagttattaataagtatgcatgtgtatgtgtatatatgtatacctagatactttttatatatgttatttttagtctttgtgtttgtttataactatgcctacctacattgatttttcaggagcattatacaaattaaaataactgtcaatattaatgaa

SEQ ID NO: 359112 - DNA, 354 bp, Homo sapiens
atggcttctaagatataagagatcagatataccaatgaccctaactggggcgggttagcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359113 - DNA, 460 bp, Homo sapiens
  misc_feature (453)..(453): n is a, c, g, or t
  misc_feature (455)..(459): n is a, c, g, or t
ctggcttaatttcttttaaagcatctttgatcattaagttgaaatatgaatgtttagtctgaaaatagcagatttttaaaagtactatttggacatagaattaattatttcttatcccatctccttttcttccttctgtgatttgcttagattgccaccaaggagccaatgaatcccattaaacaatatgtaaaggatggaaagctacgctatgtggcgaatatcttcccttacaagggttatatatggaattatggtaccctccctcaggtaacatttttgttacaatggtaaaatgttcctgtcttctgaaaaaattgccttataaatcctgtgaactactgaatttaaattggttctgaggacatgtcatttggagaggtttgtaaatttggaatttattaacgtggatggagttttagtatatcaataaattttgttttaaaccataanannnnna

SEQ ID NO: 359114 - DNA, 614 bp, Homo sapiens
gggaaagcaaactgtattccttatatggtaagctaacaaattgtttctttgcgatactatcccatttggggcattttttgtgtagtcaaattttacaatacaagctttatctaaacctttcatattatagcacttctatgttgtctgctagagactaaaatgacccagaaagatacaagaaataaagtaggaaggctctagaatttttaatgtagctttatataaggcttgggccaaatgagagaacttgggacgaaagtttgaagggaaatagctttaaatagagaaatgcaactttagatagcttatgactgtttgtatctgcctaaatacttcctaaaagtcgaaattaaatttgattaatcactcccttctccctcctcttatcccttccctaataccctctttccccattttaaatgcagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359115 - DNA, 781 bp, Homo sapiens
gggaaagcaaactgtattccttatatggtaagctaacaaattgtttctttgcgatactatcccatttggggcattttttgtgtagtcaaattttacaatacaagctttatctaaacctttcatattatagcacttctatgttgtctgctagagactaaaatgacccagaaagatacaagaaataaagtaggaaggctctagaatttttaatgtagctttatataaggcttgggccaaatgagagaacttgggacgaaagtttgaagggaaatagctttaaatagagaaatgcaactttagatagcttatgactgtttgtatctgcctaaatacttcctaaaagtcgaaattaaatttgattaatcactcccttctccctcctcttatcccttccctaataccctctttccccattttaaatgcagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaattactctcctttggacatttattgatataaaaagaagattttggccaggcacggtggctcatgcctgtaatttcagcactttgggaggccgaggtgggcagatcacaaggtcaggagttcaagaccagcctggccagtatgttgaaaccccatctctattaaaaata

SEQ ID NO: 359116 - DNA, 1364 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaattactctcctttggacatttattgatataaaaagaagattttggccaggcacggtggctcatgcctgtaatttcagcactttgggaggccgaggtgggcagatcacaaggtcaggagttcaagaccagcctggccagtatgttgaaaccccatctctattaaaaata

SEQ ID NO: 359117 - DNA, 1627 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagacagggtctcactcctgccacccagactgtagtgcagtggtgatcatggctcactgcagcctcggcttcctgaactcaggtgatcttctccctcagcctcacaagtagctggaactacagatactgcaacatggaagtggagtcaatacatactaatatagtggccaggcacacaggagccgtcacttgtagcatgtgagcacataaacaatttcaagtttatggtataactgaggccatgtggttacagacactctgactgctcctaattaatggctaaactgtacaattcagataatgaaatcatctcaagttattcacattagcaaatacaacttcttatcgcatgactgccaaacaggcattttgatgcccattttataaatgtaaaagtgcacgctgaactctcttcctttcaaccaaagattgggctttcctatcagtggccgcaaagaggggagaggccctgggcttcacttactctgcattcaaggcacaccggcgattggtgagcgtgccgtatttcctcagcgtctcggtaagctccgagtagagtttgtcagccagagacagcgggattccttcccacaccaggatgagaatcacaatcactgcagcc

SEQ ID NO: 359118 - DNA, 1566 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagacagggtctcactcctgccacccagactgtagtgcagtggtgatcatggctcactgcagcctcggcttcctgaactcaggtgatcttctccctcagcctcacaagtagctggaactacagcaatgaatgaaggttcctgttgctccacattctcaccagcacttggtttcatcagtgttctgacttcagccattctaacaggtttgaactgcatggactgcttatatgtgaattttcttccacttctgccacccctggaacagcaagaccaacccatccttttcctcctcttcttcagcatactcaaggtgaagacaacaaaggatgaagatctttatgatgatctacttccatttaataaatagtactatattgtacattccactgtaaatgagcaaacattacactggcagcagggaccagcatcctttatcaagaggcagttgtagctcaagagttgcatcttggtagcatcaatacagaatttaaggattacagaagatatctcaaaagttctctatacttggaagaaaaataaagaacgatttgcacttcaaa

SEQ ID NO: 359119 - DNA, 1087 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359120 - DNA, 1110 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359121 - DNA, 1000 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359122 - DNA, 842 bp, Homo sapiens
tttttttaaaattcttactgtttatttatatattgcatagctcaaaaagtttgaaaaaatgaagttttaacaggaagtcagtaaatgctcatagacccccttgtctctagcacttggagtccttagagatgggaatcttgacagcagaatttcagatgtttcaatcacttgccaaggaagtgccacacttgctcttcttcattacattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359123 - DNA, 891 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359124 - DNA, 984 bp, Homo sapiens
gttccttctaccttttcccctcttgtccagttagtgatgtacttctcacttttataatgctttcttttactccctcttctatgacattaccattgcttctgtttatctctgttaaaacctcattgcattttaattgcagtttatctatttgtctctttccctgagttaaaaactgagtatcttgatgaaaagaactttgttgtatccatccatttattccccatacatagcacattgtctgaagatgctttgtaaatgtttgtagagtgcaggaatagtattatacatatgaaaacacaaaagtctgaaggtgatatacatatcaatgatgatgctgctctaggtatcacaatcaattgtgcttctggttagactgggccccatgtttcctggctccctcagtccaatgctctgccactaaagggaattaattttggttcttaacaaaacatctttttgtttttttctttacagatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359125 - DNA, 1414 bp, Homo sapiens
gttccttctaccttttcccctcttgtccagttagtgatgtacttctcacttttataatgctttcttttactccctcttctatgacattaccattgcttctgtttatctctgttaaaacctcattgcattttaattgcagtttatctatttgtctctttccctgagttaaaaactgagtatcttgatgaaaagaactttgttgtatccatccatttattccccatacatagcacattgtctgaagatgctttgtaaatgtttgtagagtgcaggaatagtattatacatatgaaaacacaaaagtctgaaggtgatatacatatcaatgatgatgctgctctaggtatcacaatcaattgtgcttctggttagactgggccccatgtttcctggctccctcagtccaatgctctgccactaaagggaattaattttggttcttaacaaaacatctttttgtttttttctttacagatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagacagggtctcactcctgccacccagactgtagtgcagtggtgatcatggctcactgcagcctcggcttcctgaactcaggtgatcttctccctcagcctcacaagtagctggaactacagatactgcaacatggaagtggagtcaatacatactaatatagtggccaggcacacaggagccgtcacttgtagcatgtgagcacataaacaatttcaagtttatggtataactgaggccatgtggttacagacactctgactgctcctaattaatggctaaactgtacaattcagataatgaaatcatctcaagttattcacattagcaaatacaacttcttatcgcatgactgccaaacaggcattttgatgcccattttataaatgtaaaagtgcacgctgaactctcttcctttcaaccaaagattgggctttcctatcagtggccgcaaagaggggagaggccctgggcttcacttactctgcattcaaggcacaccggcgattggtgagcgtgccgtatttcctcagcgtctcggtaagctccgagtagagtttgtcagccagagacagcgggattccttcccacaccaggatgagaatcacaatcactgcagcc

SEQ ID NO: 359126 - DNA, 1080 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaggccctcagcggtagccgcgcggtccaggccaccttacttcccgcgggagcgcgcaccgagtcacgagaactgccagcgaggaggcggcggatcaagaccccaaagcggagagcagaggcgcagggctgccggctggggggtagatagcgccctgtgccctgccagccgccctccccgaggggtaggcagagtgcaagcggccaccccgcggcggcctgcagccattagccggcccggccgccgttcccggttcacacaactcagtgaggaagggaaggcagagcccgcccacacgccggccttcctagaggcgtaagaaacctcctactgcgggagctccctgacgtcggagaggcaggcggaactttgcggatgcctaatccagcgcgtcttctttttttggagggactctgatgaaggttctttccccagaagcttgacttgagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagatcatctctgttaatgcccatgttagaatggagcagtctgggtgcagtggctcatgcctgtaatcccagcacttt

SEQ ID NO: 359127 - DNA, 216 bp, Homo sapiens
tgtttttgctacatacatatggaaggtatttgacctgggaatcccaaagtttctcattagacttactttctgtttcagatactgcaacatggaagtggagtcaatacatactaatatagtggccaggcacacaggagccgtcacttgtagcatgtgagcacataaacaatttcaagtttatggtataactgaggccatgtggttacagacactctg

SEQ ID NO: 359128 - DNA, 593 bp, Homo sapiens
atccacgcgtccggacccacgcgtccggttggaggaagatatggggaggtaggaaaatgggacttttttcctccatttactttatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359129 - DNA, 1513 bp, Homo sapiens
  misc_feature (1340)..(1340): n is a, c, g, or t
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaaaaaaaaaaaaaaaaaaaaaaaaaaaatcggttgggcggcgcctctgcgccctctacgaaaaagcatttctcataagacccatccgtgttggggcgcggcgcgggcgccccagggtagcggtaaccgtgcgacactgggcgccnacaacgggcgggtgtcccaagagggagaacccgggcgccaagtgggacatagggggcgtggcagttctcccacccaataaaaaacaaccgcccggcggggacgaccggagcgcgtccttggcaccaattccagagtggagtcccggagagccatacagggggtccaatccaac

SEQ ID NO: 359130 - DNA, 1642 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaggccctcagcggtagccgcgcggtccaggccaccttacttcccgcgggagcgcgcaccgagtcacgagaactgccagcgaggaggcggcggatcaagaccccaaagcggagagcagaggcgcagggctgccggctggggggtagatagcgccctgtgccctgccagccgccctccccgaggggtaggcagagtgcaagcggccaccccgcggcggcctgcagccattagccggcccggccgccgttcccggttcacacaactcagtgaggaagggaaggcagagcccgcccacacgccggccttcctagaggcgtaagaaacctcctactgcgggagctccctgacgtcggagaggcaggcggaactttgcggatgcctaatccagcgcgtcttctttttttggagggactctgatgaaggttctttccccagaagcttgacttgagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359131 - DNA, 1132 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttagaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359132 - DNA, 1143 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359133 - DNA, 2612 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaggccctcagcggtagccgcgcggtccaggccaccttacttcccgcgggagcgcgcaccgagtcacgagaactgccagcgaggaggcggcggatcaagaccccaaagcggagagcagaggcgcagggctgccggctggggggtagatagcgccctgtgccctgccagccgccctccccgaggggtaggcagagtgcaagcggccaccccgcggcggcctgcagccattagccggcccggccgccgttcccggttcacacaactcagtgaggaagggaaggcagagcccgcccacacgccggccttcctagaggcgtaagaaacctcctactgcgggagctccctgacgtcggagaggcaggcggaactttgcggatgcctaatccagcgcgtcttctttttttggagggactctgatgaaggttctttccccagaagcttgacttggtacgcacaagtttacaccctgagtgtgatccaccatccaaagcctcgttggttccggagcagccccttttcctccccaagctgaacaagcccagaaggctaagcgacttcgggggggtccctgagttgccgagctcagagaaaggacccaggtcttcgtgactcattgttccgtgtaccccattgtttcactgtgtacgttaaccgtaacagaaaatagcgatgtcggtcgcttgccttcactccccactgactgcagagccttggagtggtagtatcaaagtgggccttgcattatcgctccccttttcggagcactggctctggaggctttcagttctaagcaggccctcgagttcttcacgtcttaactctgtgaccccggacgagtttaagttgctaagccttgttttttctcatccgtaaaatagggctgcaagtattacatgacattatatatgtaaactgattagtcacagggcctaaaatataaattactattgttaataccgataatcattatagatatttgtaatttatgagagatttgcagttatgctacatgagtttagggtcgaggattattttgtgggaaagaagagtttgcctaaagtcgtgtgattataatgcaactagtactagaatttctattttcttcaaaattggttgcagttttcaccctatgccacatattttcttctatctttggttaagactgatcaggtgaacaggaagtctcaaatttctgaatggattatgttctaaaaggttaccatgtgatgattaatgggaatagtcagaaaaaattatgaagtggcagttcgctttttaagcagattgaaaaaaggcctgtctactgcaagtattctagatttgcaataagtacggtaattaatagatacccaaataataaatatttatgaagtgtgctagacactgttaggcatagtacagagattcacaatattactataattatggaaaaagtaaatacactggttgagcaaaaacaggcttgagaagccaggagcgcacagagtagttgacccagtaccggatttggaatggggagtcctaggccataatcttggctctgccgttaactcgctgtgtgctgttgggtgggtggttacttcagttctttctcacagagccagtttcttcagctgtaaaatgaagcttttgaccttgaaacgatgatcctcaaggtccttctcagcactggtattccctgaaggcattggatgaataacggagattctaacagtctctgttaagacaggatgtcgaatgggggcatttttgggagtatgttggcctcttattgttggtttgtttctttagctgcaaatgtacttaggactcatgatttttctgtaactagagtgccacaaataaaatacgtttttcattcagttggataaacagggcaggaaagaagaaaacccgattttactaaggtaaatgggcaaaaactggaagaaaggggagtgtggttttggagagggtcccgatggtaagatcctgattggaaggtgtgttggttaaacaatttctgaactaaccgccagatggcatcactggccaggactgtttactacctgctagaaggggtagggcaaagtgaaacgaagccactctagggcgaatggggtaaggggaaagcaacgaataaattgccctttataaagatgatcacagattggatatttattactcagtgtgtctgtatgcagtactagggtggactaatgtctcacttcaaaaaaaatatgagtgtagtatacttggcctaaaattgttactcagtgttactaaagtgtaatcattttccacatctccaaatatattccaagtctctgaaatactagtgcattgggaggtagaacattttcgagcttcatgtctgtaaatggtttctctttactgtcattcagtaaaatcagaataaatgattgatgtaatacttaaaaaaaaa

SEQ ID NO: 359134 - DNA, 699 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcaggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 359135 - DNA, 747 bp, Homo sapiens
tgcggttggggaccagtgcagggaccgggtcgcgccgtgctatggccctgtaccacactgaggagcgcggccagccctgctcgcagaattaccgcctcttctttagtaagtagctcccggaggttcgccgagcggcgcaccggagaaacctgggtgggggatggaatgggggacacttgggacgccccgcgcggtctcccttctctctttttggggccctcagcggtagccgcgcggtccaggccaccttacttcccgcgggagcgcgcaccgagtcacgagaactgccagcgaggaggcggcggatcaagaccccaaagcggagagcagaggcgcagggctgccggctggggggtagatagcgccctgtgccctgccagccgccctccccgaggggtaggcagagtgcaagcggccaccccgcggcggcctgcagccattagccggcccggccgccgttcccggttcacacaactcagtgaggaagggaaggcagagcccgcccacacgccggccttcctagaggcgtaagaaacctcctactgcgggagctccctgacgtcggagaggcaggcggaactttgcggatgcctaatccagcgcgtcttctttttttggagggactctgatgaaggttctttccccagaagcttgacttggtacgcacaagtttacaccctgagtgtgatccaccatccaaagcctcgttggttccggagcagccccttttcctccccaagctgaaca

SEQ ID NO: 359136 - DNA, 946 bp, Homo sapiens
gtaaagaacacattaacagcatcccagaaattcctcttgttccctgccattactgccctcactcttactcaaggaatctactatactgacttaaaaaaatagctttattgttatgtagttgatacacaataagccacacaatttataatttgataaattttggcatgagtatgtacctgtgaaactagcatcacaagcaagataatgaacacatctgtaagcccccagagttttcctgtgtatccttataatccctctctcccagctggcttcttcatttagcattaactattttgtagtttatgttgttgtgtgcatcagtatttcatttctttttattgctgtgtagtattccattgtatggatataccacagtttatccattttcctgttgatggacatgtgagttatttctgttttttgagtattataaataaagttgctataaacatttgtgtatggataagtggtttcattcctcttgggtaagtggaatggaatggctgaatcatttttaactttttaaataactgccaaactgtattccaaggagattgttcccaccagctgtgtatgtgagttctaggtgctacatgtcttcctcaacactagatatagtcttcttaatttttgatattgtgatagatgtgtagtagtatttattgtggttttaatttgtatttacctaatatctaatgatgctaagcatcattttcatgtgtttatttgccatctgtatatattctgtggtgaggtgtttgttcaaatattttattgatttttttttaaattgggttgtttggtttcttaatttttaaagaaacattattattaaagttttcaaacatatgtgaaagtagaacgaatgagcgtaacaaacttttttttttttttttttttttttcttttttgagacgcaatcgtcttgccctgtcatcacccaggc

SEQ ID NO: 359137 - DNA, 3097 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgttccagccccagggctagttgctggtccaccaggagagaaggcccaggcctggctcac

SEQ ID NO: 359138 - DNA, 3314 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgtgagtgcccatatccccctgcccatctcccccaccccatgctgagtaatgcctccaggcggcacaagcccagaggcctgttgggccggggctggggcaggtcccagtggctgccctggggttccagtacagcacttcgtcctgcagccaccacatcaccccttcccatcagactctcacccacccttgacattctgtcttcctctctccctggcaggcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgttccagccccagggctagttgctggtccaccaggagagaaggcccaggcctggctcac

SEQ ID NO: 359139 - DNA, 2816 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttggccgccttggccacgtcgaattttagatgagccagcttatgcatgcggcccgaattgagcttatttggccattccgcctataggggtgggattacat

SEQ ID NO: 359140 - DNA, 3084 bp, Homo sapiens
atatcgtcgacccacgccgtcgcgaaatggcgccgtacagcctactggtgactccggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgttccagccccagggctagttgctggtccaccaggagagaaggcccaggcctggctcac

SEQ ID NO: 359141 - DNA, 2236 bp, Homo sapiens
atatcgtcatagctgactctagagtataccctgctgatccgcaagactgcttggcaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgttccagccccagggctagttgctggtccaccaggagagaaggcccaggcctggctcac

SEQ ID NO: 359142 - DNA, 2058 bp, Homo sapiens
attcggcacaggattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgttccagccccagggctagttgctggtccaccaggagagaaggcccaggcctggctcac

SEQ ID NO: 359143 - DNA, 2549 bp, Homo sapiens
tactcacctgtgggtcccagctactcaggaagttgaggcaggaggagttgcttgagccccaggagttagagactgcagtgagcaagcctcgactgtgcccttgcactccagcctgggcgacagagcaagaccccatctcaacaacaacaaaaagagactgtctagacagaaagtgcgatgttattcaggttttatagactttttaaaaagaactcttattgccctgattataaaacaatctttaaaacccagaaaatactagaaagtataaaagaagaaaattagcatctcctgtcagccccagcccatcaaggatggctgttcgtatgagccctctgacgtgcctacacgtgtacatgatattgctgtaaaaggggtcatagtcctaatgtgttcagcatcatggccaatggctacagcatctttcttcaaatgacgccacgtcatgagttagcctgtcctttattgttggatatttcggttgcttgcaactggtctctgttaaaaaagtctctggcccagcccagatggtgaactcttttggccaagtctggataatttgaagtcaggtggagacctctgctcactgtctcctcctgacccttaaccccaccacccacaatgcaccaggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgttccagccccagggctagttgctggtccaccaggagagaaggcccaggcctggctcac

SEQ ID NO: 359144 - DNA, 3317 bp, Homo sapiens
tactcacctgtgggtcccagctactcaggaagttgaggcaggaggagttgcttgagccccaggagttagagactgcagtgagcaagcctcgactgtgcccttgcactccagcctgggcgacagagcaagaccccatctcaacaacaacaaaaagagactgtctagacagaaagtgcgatgttattcaggttttatagactttttaaaaagaactcttattgccctgattataaaacaatctttaaaacccagaaaatactagaaagtataaaagaagaaaattagcatctcctgtcagccccagcccatcaaggatggctgttcgtatgagccctctgacgtgcctacacgtgtacatgatattgctgtaaaaggggtcatagtcctaatgtgttcagcatcatggccaatggctacagcatctttcttcaaatgacgccacgtcatgagttagcctgtcctttattgttggatatttcggttgcttgcaactggtctctgttaaaaaagtctctggcccagcccagatggtgaactcttttggccaagtctggataatttgaagtcaggtggagacctctgctcactgtctcctcctgacccttaaccccaccacccacaatgcaccaggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgtgagtgcccatatccccctgcccatctcccccaccccatgctgagtaatgcctccaggcggcacaagcccagaggcctgttgggccggggctggggcaggtcccagtggctgccctggggttccagtacagcacttcgtcctgcagccaccacatcaccccttcccatcagactctcacccacccttgacattctgtcttcctctctccctggcaggcacagatcttgagggatctgggtggcattgtcctggccaatgcttgtggcccctgcattggccagtgggacaggtaagaggcgtatcttttgacaagacagccccttgtgcacagggtacagagccccagaagttggagggggaattattggggtggagagaagagactccagccaaggtctctagctccagggactcttgcccattagaagcctctggcagacatgcctgggaagaggggctgggtgaggaagggccctgcagaggcactggggggcaacttggctgaagcctgggctggcaggaggaagccagcgcggcctcaccctgacggacacagcaggagccgtttgggaggaggcagtgccccaggtcaggaaactcaggccttgaccaaggccttgcctctggcttacgtgtggttgcaggctgggcccagtgatcctgaggttcccttctgctctgcgcgtggccccaggaggaggcaaccctggcagggcctcttcattttccctcggtaggagctaggctgggctgcgccacaggaacccagcttatctgtcctcgggacaggccaggtgacaaggccagatatccctaaccctgatccctctgacctggcaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgttccagccccagggctagttgctggtccaccaggagagaaggcccaggcctggctcac

SEQ ID NO: 359145 - DNA, 2596 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaaggttaggggcccgggtccccctgaggtggtggggtgaggggcagccaccttgtttcccctcctgcactggccccagggtagcttctcccaggaggcttcattccagctggaaaggcccccagttctccaggtggccccacagagaaagcaaagtggcttctcagagttgggggttggagtcaacccggggccctcacacctccccaacctccctttactcaccaggacctggcactcaggggacagcccacccactgcaggaccctctgggccccaggaatcccctgtaggtgccacctgggtctgacctgggccatcaggcacagactggcctaggatttggtttgcc

SEQ ID NO: 359146 - DNA, 2631 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgttccagccccagggctagttgctggtccaccaggagagaaggcccaggcctggctcac

SEQ ID NO: 359147 - DNA, 2224 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaactggagaaccgggctgtggctctgacttcgtgaccggtgatacacagattcacctgtggacagtggcatccaggccgaggatcacctggca

SEQ ID NO: 359148 - DNA, 2209 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccacctaattggaagcgccaccctagcaatatcaaccatataaccttccctatccgcttatcaatggaatcctctagagt

SEQ ID NO: 359149 - DNA, 1690 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgttccagccccagggctagttgctggtccaccaggagagaaggcccaggcctggctcac

SEQ ID NO: 359150 - DNA, 2152 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggtaagaggcgtatcttttgacaagacagccccttgtgcacagggtacagagccccagaagttggagggggaattattggggtggagagaagagactccagccaaggtctctagctccagggactcttgcccattagaagcctctggcagacatgcctgggaagaggggctgggtgaggaagggccctgcagaggcactggggggcaacttggctgaagcctgggctggcaggaggaagccagcgcggcctcaccctgacggacacagcaggagccgtttgggaggaggcagtgccccaggtcaggaaactcaggccttgaccaaggccttgcctctggcttacgtgtggttgcaggctgggcccagtgatcctgaggttcccttctgctctgcgcgtggccccaggaggaggcaaccctggcagggcctcttcattttccctcggtaggagctaggctgggctgcgccacaggaacccagcttatctgtcctcgggacaggccaggtgacaaggccagatatccctaaccctgatccctctgacctggcaggaaggacatcaagaagggggagaagaacacaatcgtcacctcctacaacaggaacttcacgggccgcaacgacgcaaaccccgagacccatgcctttgtcacgtccccagaggtgagactgcccagctgcgcacaagcctgggatggcctctgggggtcctggcgggtcagaggaggaggcagaaggagat

SEQ ID NO: 359151 - DNA, 1466 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtggacgccctggcatgccagtcactggcatctgctgctgctgggtacagtgtggctgtgaagagcatggagcctggagccagatggcctgggcttgaatcctggctctgccacctaacagccactaacagctgagtgaccctgagcaaactacttcactgtctatgtgtgggttccccatctgtaaaacaggagtcatgatcgtactgacacctttgaaggtggtgttgggcctactgctgctatcaccaatgagaaaaataaataaaaaataaagttgtctggagaagtg

SEQ ID NO: 359152 - DNA, 1458 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtgagcaccttccaccccatctgtttagcaggtctcagggccagtggctctgcccagggctgtagacaatcacctatgcctactgtgtggcactttctaaggtgggcagtttctgaaatgggtttattattgaaaaattactttttcggccagaagtggtggctcatgcttgaaatcccagcatttcaggaggccaatgcaggtggattacttgagtctaggggttcaagaccagcctgggcaacatggaaaaaccccgtctcttaaaagaaaatgcaaa

SEQ ID NO: 359153 - DNA, 625 bp, Homo sapiens
atatcgtcgacccacgccgtcgcgaaatggcgccgtacagcctactggtgactccggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgccctgacctggctcaccctgtggcagaagtgggcaaggtggcagagaaggaaggatggcctctggacatccgagtggacgccctggcatgccagtcactggcatctgctgctgctgggtacagtgtggctgtgaagagcatggagcctggagccagatggcctgggcttgaatcctggctctgccacctaacagccactaacagctgagtgaccctgagcaaactacttcactgtctatgtgtgggttccccatctgtaaaacaggagtcatgatcgtactgacacctttgaaggtggtgttgggcctactgctgctatcaccaatgagaaaaataaataaaaaataaagttgtctggagaagtgacaatatgtgaaaagagatttctataccgtctggccgaaaataagggcaatataatgtgt

SEQ ID NO: 359154 - DNA, 250 bp, Homo sapiens
tcgtggaataccacgggcctggtgtagactccatctcctgcactggtgaggaaggcggccaggcgacgtggcccctaccctgtgctgggcctgatgggtctccagttgggagtagaagcggtgaatggccttcacttgagaatctgtctgttccatttggggacttgggatagacagaggtagaaggaaaattggagacagcattagagattgtctagtccacatcctcattaaacagatgaagagattg

SEQ ID NO: 359155 - DNA, 743 bp, Homo sapiens
ttcccgtggccagagtgagccttgcccttggcggtattcagccctggccgtgactggcacatggccaggctctcttgacttggttgtttatctgcgtgttctacaaatatgtcttgctaaatgggtgaaggaatggctccttccatgtttttagtgtcctgcgcactgagcaggtttgcatcataccagcatttctgcgccagggcccccactccctccaggatagctgtgaggagagagaacagcactgccggcccggccctgcagggatgggagaggccgcactgcccttggcttcctgagtcctctgcaggcccaaggccccgtggtcccaaagatcgtcctgcagctctggcctctgaggaacacaggggtctgggaagaacatggaaatttcctgggttcctttctcagttttggcctaggcttttggtaggtgcaggagacaggagtggcaattggtgctgaccaacaaactggccacctccatttcagattgtcacagccctggccattgcgggaaccctcaagttcaacccagagaccgactacctgacgggcacggatggcaagaagttcaggctggaggctccggatgcagatgagcttcccaaaggggtgagcgcccacgccccctgcttgctggttgctgtgtggccacgtcacttccttctcaacctcacagcacctcctgtgcaggcagggagggcgctgctagtgagaaggaagcagctctgttccct

SEQ ID NO: 359156 - DNA, 860 bp, Homo sapiens
gggccatcatcaccaagagctttgccaggatccacggtgagctggagtctgtacccaggccatcctcatcccatccctagtgatcaaggtcactctccctgcccgtggctgagttgggcctggttctaggctgtgtccactgcagcccacaggcccgtcagcctcttgccccttcttaggctcacacagtgcacatccgacgctcagcttcccggcttcccgcaggccctgcttccaggcttgtagatctgagccgctgagatctaggacatgtgccagggggttctttctgatcatgaatgtgcagcaggaaggcctcgcagacctcagcaccagcgcacacttgctaggggcacccctagtgaaagggagcagaccagggccccatagtcactgcccgggcattgtcccaggcagcaggattaggggcatctcccagagccccagatgggttcagaaaatgaagctctccaggctagtcaggcccccgatgaccgaatgccgcctgctttccagagaccaacctgaagaaacagggcctgctgcctctgaccttcgctgacccggctgactacaacaagattcaccctgtggacaagctgaccattcagggcctgaaggacttcacccctggcaaggttaggggcccgggtccccctgaggtggtggggtgaggggcagccaccttgtttcccctcctgcactggccccagggtagcttctcccaggaggcttcattccagctggaaaggcccccagttctccaggtggccccacagagaaagcaaagtggcttctcagagttgggggttggagtcaacccggggccctcacacctccccaacctccctttactcacc

SEQ ID NO: 359157 - DNA, 643 bp, Homo sapiens
aactgcagactcaagcaacagagcctgcctccaaaaaaaaaaaaaaaaaaaaaaaagaaagaaaagaaaaattactttttcttggcagaaaagaaaaatatgtttattgtagagaatattcacaatcaagaagaatttttaaaactcctaatctcaacccccagccaggagcaagctcttagagctcttggagaggtgtgctgtgtttctgtgtattgtgtgcatagattttcccgttttacattttatatcacccatgctgctttatgtgacttttcatgctttacacatgcagacgccctggcatgccagtcactggcatctgctgctgctgggtacagtgtggctgtgaagagcatggagcctggagccagatggcctgggcttgaatcctggctctgccacctaacagccactaacagctgagtgaccctgagcaaactacttcactgtctatgtgtgggttccccatctgtaaaacaggagtcatgatcgtactgacacctttgaaggtggtgttgggcctactgctgctatcaccaatgagaaaaataaataaaaaataaagttgtctggagaagtgacaatatgtgaaaagagatttctataccgtctggccgaaaataagggcaatataatgtgt

SEQ ID NO: 359158 - DNA, 2881 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgacaaaagcaaacagccaccaaccagccaaacacagaagaacaacagcgacaaaaagaaaagaagagaaccgggcgggcagggagaggggaggaaacgggggagacaggagcgcaggaatagtggcacgaaggag

SEQ ID NO: 359159 - DNA, 2033 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatgccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgttccagccccagggctagttgctggtccaccaggagagaaggcccaggcctggctcac

SEQ ID NO: 359160 - DNA, 1477 bp, Homo sapiens
acggatagcggatctgctcggaacctggagtgatggtgaactgggacttgcacttgaggccatgggccagtgcctgcttggccacagctgctgaggccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgttccagccccagggctagttgctggtccaccaggagagaaggcccaggcctggctcac

SEQ ID NO: 359161 - DNA, 2206 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccagctggagctccagctggcacccaaggctgtttgatgctgggatcctcttgtgggggggcgtctgtcaatgtcaccattttggaagtgcgcagagctcagaacggcgcttccatgc

SEQ ID NO: 359162 - DNA, 2296 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgacccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgttccagccccagggctagttgctggtccaccaggagagaaggcccaggcctggctcac

SEQ ID NO: 359163 - DNA, 1028 bp, Homo sapiens
cgatcaccacccacctgatgccatgtttcttgtagtagcgggcagtgtcagtgcacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgttccagccccagggctagttgctggtccaccaggagagaaggcccaggcctggctcac

SEQ ID NO: 359164 - DNA, 1526 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtggacgccctggcatgccagtcactggcatctgctgctgctgggtacagtgtggctgtgaagagcatggagcctggagccagatggcctgggcttgaatcctggctctgccacctaacagccactaacagctgagtgaccctgagcaaactacttcactgtctatgtgtgggttccccatctgtaaaacaggagtcatgatcgtactgacacctttgaaggtggtgttgggcctactgctgctatcaccaatgagaaaaataaataaaaaataaagttgtctggagaagtgacaatatgtgaaaagagatttctataccgtctggccgaaaataagggcaatataatgtgt

SEQ ID NO: 359165 - DNA, 673 bp, Homo sapiens
acgtcagcggaatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggtgagcagaaggtggctttgggggtgggcaagtgggcaagactgggcgagaggcctcaccctcacactggagcaaaccagggcattgcctccaaattctcacacctctttggattggtctgcttttaaaacttgattttacttgtttctctttctaaaaatagcacttgctcattatgttaaaaaatacagaggaagccta

SEQ ID NO: 359166 - DNA, 957 bp, Homo sapiens
  misc_feature (818)..(818): n is a, c, g, or t
  misc_feature (835)..(835): n is a, c, g, or t
  misc_feature (839)..(839): n is a, c, g, or t
  misc_feature (844)..(844): n is a, c, g, or t
  misc_feature (847)..(847): n is a, c, g, or t
  misc_feature (862)..(862): n is a, c, g, or t
  misc_feature (864)..(864): n is a, c, g, or t
  misc_feature (866)..(866): n is a, c, g, or t
  misc_feature (869)..(869): n is a, c, g, or t
  misc_feature (875)..(875): n is a, c, g, or t
  misc_feature (878)..(878): n is a, c, g, or t
aatataggctaggtagaggctgggtgttgaattcgccgaggcaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagnaagttgtcctgactgtncaancttancgnacgttggacatctgngnantcngggggncanaagcctccttgtttgattgtccccttgggccccctgggccctgcttcacccccggtctcggggcgggaacaatcgggga

SEQ ID NO: 359167 - DNA, 2507 bp, Homo sapiens
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359168 - DNA, 2472 bp, Homo sapiens
cggctaggtcgaggccggtggttaaatcggccgagtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359169 - DNA, 2378 bp, Homo sapiens
tatccgtgttcggagttgcggtttctccgttagtgcttccgggttgcagccagggaagcctccgcggtggttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359170 - DNA, 2310 bp, Homo sapiens
tgctagtagaggccgggtggtttggcgacgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359171 - DNA, 1797 bp, Homo sapiens
tatccgtgttcggagttgcggtttctccgttagtgcttccgggttgcagccagggaagcctccgcggtggtgcaagtggaacccaagccttgaggtttcagtgtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359172 - DNA, 2638 bp, Homo sapiens
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgtaagctcctctccctccttccctcctgcttggtgtcctggcaatgctggagagtagaagctgaggggctcagccccaggcatgaggctgagggccccagtaactgtgggttccctttcacctatccccaggaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359173 - DNA, 2531 bp, Homo sapiens
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgagaagatgttgcttgtatggtgtctgc

SEQ ID NO: 359174 - DNA, 1347 bp, Homo sapiens
acagaacgtgtggaacatctgagtgaattcctggtggagcagcgcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359175 - DNA, 2326 bp, Homo sapiens
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgagttcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359176 - DNA, 2061 bp, Homo sapiens
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgagtcttacccacagctgactagggccagcgcaaatactggaacctgtaacagaattaaaggtgaatgttctgaga

SEQ ID NO: 359177 - DNA, 955 bp, Homo sapiens
  misc_feature (41)..(41): n is a, c, g, or t
gctgcggtcactctaaggatcccgggttatcgatgccaccnaggcccacagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359178 - DNA, 1704 bp, Homo sapiens
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359179 - DNA, 1281 bp, Homo sapiens
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttactcacaaacggcagaaaacccggggcagggcacaacaaccggcgtgtcaacacgggggagccacggaggcagcatgacggccgcacaagccccaagggctgccagcgccgtgatcagcaccagacaaagcgacgcaaccccacaggccgacacaccacacaccacaaaaaaggacacagacggacaaaccaaacaaaacaaagaaaaacagacaccaacccaacatcggacaaacaacagacgcagccaacaccgcccccgctccccg

SEQ ID NO: 359180 - DNA, 1126 bp, Homo sapiens
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcaccttcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359181 - DNA, 888 bp, Homo sapiens
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcaccccctccccactcttgcccatgggtgactcttacccacagctgactagggccagcgcaaatactggaacctgtaacagaattaaaggtgaatgttctgaga

SEQ ID NO: 359182 - DNA, 484 bp, Homo sapiens
atggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagtgagtaagagggaccctggactagggtggaggatccccaaatctccccacccccgacccttatgccgagatcaaggaagggtagggccattcattacttcccacccttcccaaatgtcacagtggttgacactcaattggtgctaag

SEQ ID NO: 359183 - DNA, 997 bp, Homo sapiens
tatccgtgttcggagttgcggtttctccgttagtgcttccgggttgcagccagggaagcctccgcggtggttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcaccttcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359184 - DNA, 377 bp, Homo sapiens
cggcacgaggggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctgccctccccactcttgcccatgggtgactcttacccacagctgactagggccagcgcaaatactggaacctgtaacagaattaaaggtgaatgttctgaga

SEQ ID NO: 359185 - DNA, 2118 bp, Homo sapiens
tatccgtgttcggagttgcggtttctccgttagtgcttccgggttgcagccagggaagcctccgcggtggtgcaagtggaacccaagccttgaggtttcagtggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359186 - DNA, 2383 bp, Homo sapiens
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359187 - DNA, 2215 bp, Homo sapiens
cggctaggtcgaggccggtggttaaatcggccgagtgcaagtggaacccaagccttgaggtttcagtgtttccccctcccaggatttcgactcagttcagcgaagtcaccgccccgtctgagaaatgaggacaccaaggcttagagcacagccccgaggcgccgtctaccaggccccgtcccctcccccggctcctgtcggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359188 - DNA, 3318 bp, Homo sapiens
  misc_feature (2915)..(2915): n is a, c, g, or t
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgagacaaaaaaaaaaaaaaaaaagaaaaaaaaacaagcatgtgtgctggcgcgcggccctggtgcgctgtggaaaaaagttttttatagaaccatgctcggttggggcgcgcgcgggggcccccaaagtatggtggaaagggtgaccagggccgccaatagcgcgtgtgttccctctagggagaaccccgtgggcctagcgactatcggtgctgtggggttttctcaccccaattataaaaaacaagcgccggggggggcgacacaccgggcgcgtgttctggaacaaaccctaaaggggagcttccgggaggcctcaatacggggtggtccttatccaacacgggggagcgccgcaaagggaggagcgcccgagatttttaaatattaccggcccgcgtcggcgggggggnccaagtcactagcggtaactgaccaacatacaggaagcctacagcacgaacacaacagtactatacaataacacccacaacacactagcgcagcagtcacaacacccacatacacggcgacacaccacaaataccctacgaccagactagacgaatcgcaggacatagcaggcgaacaccaacggataacaaagctggcacgcaacggactcgagccgtcaaccacatcgaagcccctgcccacacaatcaacccgtctgaagccacgggagaagcgaaacagtggcgagaaggagtcactaagcccgtggaacccacatcccccgtaacgagtcaatccagagcagacgaaaagacacaggcaacaacaaccaagcgacaccacacaaaaaaaacaccatgc

SEQ ID NO: 359189 - DNA, 1587 bp, Homo sapiens
cacaggagttagtgcgttacagccgaccagctgtgacatgcgtgattgtccgatcaatgtgcctggttttacacagattgtgatcggactttctcctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359190 - DNA, 2722 bp, Homo sapiens
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgtaagctcctctccctccttccctcctgcttggtgtcctggcaatgctggagagtagaagctgaggggctcagccccaggcatgaggctgagggccccagtaactgtgggttccctttcacctatccccaggaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacaggtaataactggggaaggctgaaagtggcctggagtgaggagctagccaggcctctgtgctcagttgtctgtctgtgttgtccagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359191 - DNA, 2448 bp, Homo sapiens
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctgaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359192 - DNA, 2090 bp, Homo sapiens
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaacctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359193 - DNA, 2055 bp, Homo sapiens
tatccgtgttcggagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgtaagctcctctccctccttccctcctgcttggtgtcctggcaatgctggagagtagaagctgaggggctcagccccaggcatgaggctgagggccccagtaactgtgggttccctttcacctatccccaggaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacaggtaataactggggaaggctgaaagtggcctggagtgaggagctagccaggcctctgtgctcagttgtctgtctgtgttgtccagccctccccactcttgcccatgggtgactcttacccacagctgactagggccagcgcaaatactggaacctgtaacagaattaaaggtgaatgttctgaga

SEQ ID NO: 359194 - DNA, 919 bp, Homo sapiens
ctcttcccagagccactgatgccagtcagcccaattacatagagacatgtggggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359195 - DNA, 638 bp, Homo sapiens
aatctgtaccggctggtgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 359196 - DNA, 690 bp, Homo sapiens
accgcttccgccttgagaatgtaacccctgagggagactggcagagggagtggatgggggatggggaaggccattttgagggggctgttggaagtaccatggccccagaggagagaagtgggggctcagggtggtgggaagaagcaaggaggaactggttctcagtttgcccgctgagtcggaggaggaggagcctgggtaggaaggggaggatgggggggcaggttggatgtcagggtcttcctctcactccctccttccctctttttaccctttcctctttaccccaggacctggaggaacttgctttgtaccagatccagctgctgaaggacctcagacatacggagaatgaagaggacaaagtcagctcctccagcttccgccagcgaatgttggggaacctgcttcggcctccatatgtaagctcctctccctccttccctcctgcttggtgtcctggcaatgctggagagtagaagctgaggggctcagccccaggcatgaggctgagggccccagtaactgtgggttccctttcacctatccccaggaaaggccagagctccccacatgtctctatgtaattgggctgactggcatcagtggctctgggaagagctcaatagctcagcgactgaagggcctgggggcgtttgtcattgacagtgaccacctgggtcatcgggc

SEQ ID NO: 359197 - DNA, 811 bp, Homo sapiens
tagggaagtttaattacttctaatttccccagataaggagttttgcctctggatggcctgttggatggttaccaggtggtctttgctcccttctaaattcctcagataagggccaggcacagtggctcatgcctgtaatcccagcactctgggaggccaaggtgggtgaatcacttgaggtcaggagttcaagaccacctgggcaacatggcgaaagcccgtctctactaaaaaatacaaaaattagcccggagtggtggcacatgcctgtaatcccagctactcgggaggctgaggcatgagaatcgcttgaatccgggaggcggaggttgcattgggccgaaaccgcgactctgcactccagtctgggcgacagaatgagaccccgtctcaaaaaaaaaatcggcaatcggtgaggcggggattattaccctcaatgtagagatttaaaaaatgaggactgaaggtgactccttccaggtctgtcagtggccagcaaagagccaatatgctaaactctcccctcccggacaccggcttcagccagagctcgcacccgcctgcgccgctccacccacccacacttccggcttccgctccgcccaccccctagtacttccgttctccagcgctgggcaccgcggccggagctgtgggctggtaagtctgcgccgccagggctcgcatggccttcagaagcggtccctgggctgggcgatgacgggtcctggtggcagcaggcccttctttctcgcatcaccgggcattacgcggcagccatttccctcgctaaggccctaccttaggatga

SEQ ID NO: 359198 - DNA, 2831 bp, Homo sapiens
ggcatgtggtctgcagaagaggaggacgtggctgggtggcagggctggtctccaaggacgagtaagatcctgcagctgcaggcttcaggaagtctcctggggctatcagatggctccttcttgtagcagcagctgtggggtccactggccctgagccctcagaggggcggccgtgggggacctcctgtcttttgccttgcaagggcctcagttgtgctttttccctctaggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtgtggtaccacattggcccaagactgttggtggggggtgcaccacctgatctctcaggtcttcgagagatcaggtctgagcccccggggtcacagggtaaagttaggagcaagggaggtggtgaggagcctggatggtgactcctgggttgccttgggctagtcgtctggcctcccctgagctgtggagtcctccccctgagctgaccttttcggtgacagtgagagggtgcatggggagcacataatgcagggcctgacacatccgtagagtccttggaaaatgtcactgctattgctgctgtctgtactaatgtcacctggggctaggccctcagacctcatggagtcctctccttgatcttccattgtgtgccccctgccctgcctcctgttctagtctcttaaggagtagttagttcttccggtgcctactgggacctggggtaccccaaggcaggggcaacctcaggtggccaggatgtggtgactgtacacatattgcatatccacaggggggcaccctaaccccacctttccagccccctttttctaatgtgggcttgtcacccctgcttgcctggttccctgggttgggatagcccctctacctgataccctcattgtcttgagaggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcctagcccacaatgactcacataccttcttctgctgcctccagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaaggttggtcctcagggcctctctaagccttagggcccctcctctccttggccttggctgtttggttaactgtcaccttccactcagggcctctgctctatatctattcccttccagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggttatca

SEQ ID NO: 359199 - DNA, 3261 bp, Homo sapiens
tagggaagtttaattacttctaatttccccagataaggagttttgcctctggatggcctgttggatggttaccaggtggtctttgctcccttctaaattcctcagataagggccaggcacagtggctcatgcctgtaatcccagcactctgggaggccaaggtgggtgaatcacttgaggtcaggagttcaagaccacctgggcaacatggcgaaagcccgtctctactaaaaaatacaaaaattagcccggagtggtggcacatgcctgtaatcccagctactcgggaggctgaggcatgagaatcgcttgaatccgggaggcggaggttgcattgggccgaaaccgcgactctgcactccagtctgggcgacagaatgagaccccgtctcaaaaaaaaaatcggcaatcggtgaggcggggattattaccctcaatgtagagatttaaaaaatgaggactgaaggtgactccttccaggtctgtcagtggccagcaaagagccaatatgctaaactctcccctcccggacaccggcttcagccagagctcgcacccgcctgcgccgctccacccacccacacttccggcttccgctccgcccaccccctagtacttccgttctccagcgctgggcaccgcggccggagctgtgggctggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtgtggtaccacattggcccaagactgttggtggggggtgcaccacctgatctctcaggtcttcgagagatcaggtctgagcccccggggtcacagggtaaagttaggagcaagggaggtggtgaggagcctggatggtgactcctgggttgccttgggctagtcgtctggcctcccctgagctgtggagtcctccccctgagctgaccttttcggtgacagtgagagggtgcatggggagcacataatgcagggcctgacacatccgtagagtccttggaaaatgtcactgctattgctgctgtctgtactaatgtcacctggggctaggccctcagacctcatggagtcctctccttgatcttccattgtgtgccccctgccctgcctcctgttctagtctcttaaggagtagttagttcttccggtgcctactgggacctggggtaccccaaggcaggggcaacctcaggtggccaggatgtggtgactgtacacatattgcatatccacaggggggcaccctaaccccacctttccagccccctttttctaatgtgggcttgtcacccctgcttgcctggttccctgggttgggatagcccctctacctgataccctcattgtcttgagaggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcctagcccacaatgactcacataccttcttctgctgcctccagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaaggttggtcctcagggcctctctaagccttagggcccctcctctccttggccttggctgtttggttaactgtcaccttccactcagggcctctgctctatatctattcccttccagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggttatca

SEQ ID NO: 359200 - DNA, 2211 bp, Homo sapiens
tagggaagtttaattacttctaatttccccagataaggagttttgcctctggatggcctgttggatggttaccaggtggtctttgctcccttctaaattcctcagataagggccaggcacagtggctcatgcctgtaatcccagcactctgggaggccaaggtgggtgaatcacttgaggtcaggagttcaagaccacctgggcaacatggcgaaagcccgtctctactaaaaaatacaaaaattagcccggagtggtggcacatgcctgtaatcccagctactcgggaggctgaggcatgagaatcgcttgaatccgggaggcggaggttgcattgggccgaaaccgcgactctgcactccagtctgggcgacagaatgagaccccgtctcaaaaaaaaaatcggcaatcggtgaggcggggattattaccctcaatgtagagatttaaaaaatgaggactgaaggtgactccttccaggtctgtcagtggccagcaaagagccaatatgctaaactctcccctcccggacaccggcttcagccagagctcgcacccgcctgcgccgctccacccacccacacttccggcttccgctccgcccaccccctagtacttccgttctccagcgctgggcaccgcggccggagctgtgggctgggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcagggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcctagcccacaatgactcacataccttcttctgctgcctccagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaaggttggtcctcagggcctctctaagccttagggcccctcctctccttggccttggctgtttggttaactgtcaccttccactcagggcctctgctctatatctattcccttccagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggttatca

SEQ ID NO: 359201 - DNA, 2717 bp, Homo sapiens
ggcatgtggtctgcagaagaggaggacgtggctgggtggcagggctggtctccaaggacgagtaagatcctgcagctgcaggcttcaggaagtctcctggggctatcagatggctccttcttgtagcagcagctgtggggtccactggccctgagccctcagaggggcggccgtgggggacctcctgtcttttgccttgcaagggcctcagttgtgctttttccctctaggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtgtggtaccacattggcccaagactgttggtggggggtgcaccacctgatctctcaggtcttcgagagatcaggtctgagcccccggggtcacagggtaaagttaggagcaagggaggtggtgaggagcctggatggtgactcctgggttgccttgggctagtcgtctggcctcccctgagctgtggagtcctccccctgagctgaccttttcggtgacagtgagagggtgcatggggagcacataatgcagggcctgacacatccgtagagtccttggaaaatgtcactgctattgctgctgtctgtactaatgtcacctggggctaggccctcagacctcatggagtcctctccttgatcttccattgtgtgccccctgccctgcctcctgttctagtctcttaaggagtagttagttcttccggtgcctactgggacctggggtaccccaaggcaggggcaacctcaggtggccaggatgtggtgactgtacacatattgcatatccacaggggggcaccctaaccccacctttccagccccctttttctaatgtgggcttgtcacccctgcttgcctggttccctgggttgggatagcccctctacctgataccctcattgtcttgagaggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcctagcccacaatgactcacataccttcttctgctgcctccagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggttatca

SEQ ID NO: 359202 - DNA, 1092 bp, Homo sapiens
cgcagaatggaactcttgctaagccagagctgtatttggtggcccatggtgggagagggaagaacaataataagttgtggaataaaagccatggagaggagcgggaattacttaatctggctccagaagggggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcagggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggttatca

SEQ ID NO: 359203 - DNA, 1550 bp, Homo sapiens
tagggaagtttaattacttctaatttccccagataaggagttttgcctctggatggcctgttggatggttaccaggtggtctttgctcccttctaaattcctcagataagggccaggcacagtggctcatgcctgtaatcccagcactctgggaggccaaggtgggtgaatcacttgaggtcaggagttcaagaccacctgggcaacatggcgaaagcccgtctctactaaaaaatacaaaaattagcccggagtggtggcacatgcctgtaatcccagctactcgggaggctgaggcatgagaatcgcttgaatccgggaggcggaggttgcattgggccgaaaccgcgactctgcactccagtctgggcgacagaatgagaccccgtctcaaaaaaaaaatcggcaatcggtgaggcggggattattaccctcaatgtagagatttaaaaaatgaggactgaaggtgactccttccaggtctgtcagtggccagcaaagagccaatatgctaaactctcccctcccggacaccggcttcagccagagctcgcacccgcctgcgccgctccacccacccacacttccggcttccgctccgcccaccccctagtacttccgttctccagcgctgggcaccgcggccggagctgtgggctggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggttatca

SEQ ID NO: 359204 - DNA, 2627 bp, Homo sapiens
tagggaagtttaattacttctaatttccccagataaggagttttgcctctggatggcctgttggatggttaccaggtggtctttgctcccttctaaattcctcagataagggccaggcacagtggctcatgcctgtaatcccagcactctgggaggccaaggtgggtgaatcacttgaggtcaggagttcaagaccacctgggcaacatggcgaaagcccgtctctactaaaaaatacaaaaattagcccggagtggtggcacatgcctgtaatcccagctactcgggaggctgaggcatgagaatcgcttgaatccgggaggcggaggttgcattgggccgaaaccgcgactctgcactccagtctgggcgacagaatgagaccccgtctcaaaaaaaaaatcggcaatcggtgaggcggggattattaccctcaatgtagagatttaaaaaatgaggactgaaggtgactccttccaggtctgtcagtggccagcaaagagccaatatgctaaactctcccctcccggacaccggcttcagccagagctcgcacccgcctgcgccgctccacccacccacacttccggcttccgctccgcccaccccctagtacttccgttctccagcgctgggcaccgcggccggagctgtgggctggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcagggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcctagcccacaatgactcacataccttcttctgctgcctccagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaaggttggtcctcagggcctctctaagccttagggcccctcctctccttggccttggctgtttggttaactgtcaccttccactcagggcctctgctctatatctattcccttccagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggttatca

SEQ ID NO: 359205 - DNA, 2241 bp, Homo sapiens
ggcatgtggtctgcagaagaggaggacgtggctgggtggcagggctggtctccaaggacgagtaagatcctgcagctgcaggcttcaggaagtctcctggggctatcagatggctccttcttgtagcagcagctgtggggtccactggccctgagccctcagaggggcggccgtgggggacctcctgtcttttgccttgcaagggcctcagttgtgctttttccctctaggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtgtggtaccacattggcccaagactgttggtggggggtgcaccacctgatctctcaggtcttcgagagatcaggtctgagcccccggggtcacagggtaaagttaggagcaagggaggtggtgaggagcctggatggtgactcctgggttgccttgggctagtcgtctggcctcccctgagctgtggagtcctccccctgagctgaccttttcggtgacagtgagagggtgcatggggagcacataatgcagggcctgacacatccgtagagtccttggaaaatgtcactgctattgctgctgtctgtactaatgtcacctggggctaggccctcagacctcatggagtcctctccttgatcttccattgtgtgccccctgccctgcctcctgttctagtctcttaaggagtagttagttcttccggtgcctactgggacctggggtaccccaaggcaggggcaacctcaggtggccaggatgtggtgactgtacacatattgcatatccacaggggggcaccctaaccccacctttccagccccctttttctaatgtgggcttgtcacccctgcttgcctggttccctgggttgggatagcccctctacctgataccctcattgtcttgagaggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggttatca

SEQ ID NO: 359206 - DNA, 2428 bp, Homo sapiens
tagggaagtttaattacttctaatttccccagataaggagttttgcctctggatggcctgttggatggttaccaggtggtctttgctcccttctaaattcctcagataagggccaggcacagtggctcatgcctgtaatcccagcactctgggaggccaaggtgggtgaatcacttgaggtcaggagttcaagaccacctgggcaacatggcgaaagcccgtctctactaaaaaatacaaaaattagcccggagtggtggcacatgcctgtaatcccagctactcgggaggctgaggcatgagaatcgcttgaatccgggaggcggaggttgcattgggccgaaaccgcgactctgcactccagtctgggcgacagaatgagaccccgtctcaaaaaaaaaatcggcaatcggtgaggcggggattattaccctcaatgtagagatttaaaaaatgaggactgaaggtgactccttccaggtctgtcagtggccagcaaagagccaatatgctaaactctcccctcccggacaccggcttcagccagagctcgcacccgcctgcgccgctccacccacccacacttccggcttccgctccgcccaccccctagtacttccgttctccagcgctgggcaccgcggccggagctgtgggctggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcctagcccacaatgactcacataccttcttctgctgcctccagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaaggttggtcctcagggcctctctaagccttagggcccctcctctccttggccttggctgtttggttaactgtcaccttccactcagggcctctgctctatatctattcccttccagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggttatca

SEQ ID NO: 359207 - DNA, 460 bp, Homo sapiens
tgcggccgcgggcgactcctggtacccccgaggccccgcgaactcaccttcacaaagctgtcggcgtccgggaagcctggcagcaccatctctccgtcggatttggttgcgctggtcgccgacaggaccctgggctcccgggtaagctcctgaagaaagcgtctagctccaactgtgcttcctccctccagtaccctctgaactcctccaagcagacgttgtttcctgcagacatcgctggaaccattctggttaacacagagtgggaactcagtacacatttgtgaagtgaactcctggaagagctcttgtgagggaggcaccgaattatcaggcagctcaagagatagattcactctcctgaaattagagatgggatgcccttaatacaattcattccacccattaagtcttcaataaatgttcagcatatccagttaaaaaaaaaaagcttttcact

SEQ ID NO: 359208 - DNA, 730 bp, Homo sapiens
tgcggccgcgggcgactcctggtacccccgaggccccgcgaactcaccttcacaaagctgtcggcgtccgggaagcctggcagcaccatctctccgtcggatttggttgcgctggtcgccgacaggaccctgggctcccgggtactgggtggcgccattttttcagcctgcacggctcgtctcgcgagagcttgtcggccgaggagacgggacgcgtgcgcaccacgcatgcgccaggtcgaagcggcgggcggggcgtctgattatagtgtggggagcctgcgattggggtggggcgcctgcgattaggttgggaagcctgcgtttagggtggggcacctgcgattaggttgggaagcctgcgattaggttgggaagcctgcgattagggtggcactttcgagcgctctggtaagctcctgaagaaagcgtctagctccaactgtgcttcctccctccagtaccctctgaactcctccaagcagacgttgtttcctgcagacatcgctggaaccattctggttaacacagagtgggaactcagtacacatttgtgaagtgaactcctggaagagctcttgtgagggaggcaccgaattatcaggcagctcaagagatagattcactctcctgaaattagagatgggatgcccttaatacaattcattccacccattaagtcttcaataaatgttcagcatatccagttaaaaaaaaaaagcttttcact

SEQ ID NO: 359209 - DNA, 514 bp, Homo sapiens
tgcggccgcgggcgactcctggtacccccgaggccccgcgaactcaccttcacaaagctgtcggcgtccgggaagcctggcagcaccatctctccgtcggatttggttgcgctggtcgccgacaggaccctgggctcccgggtactgggtggcgccattttttcagcctgcacggctcgtctcgcgagagcttgtcggccgaggagacgggacgcgtgcgcaccacgcatgcgccaggtcgaagcggcgggcggggcgtctgattatagtgtggggagcctgcgattggggtggggcgcctgcgattaggttgggaagcctgcgtttagggtggggcacctgcgattaggttgggaagcctgcgattaggttgggaagcctgcgattagggtggcactttcgagcgctctggtgtgaatttcacgttcttttacctcatattgtatcatcccaacaaccctgtgatctagggtgcggcctggaggacctgactatcacatatatttttgacacg

SEQ ID NO: 359210 - DNA, 556 bp, Homo sapiens
tgcggccgcgggcgactcctggtacccccgaggccccgcgaactcaccttcacaaagctgtcggcgtccgggaagcctggcagcaccatctctccgtcggatttggttgcgctggtcgccgacaggaccctgggctcccgggtactgggtggcgccattttttcagcctgcacggctcgtctcgcgagagcttgtcggccgaggagacgggacgcgtgcgcaccacgcatgcgccaggtaagctcctgaagaaagcgtctagctccaactgtgcttcctccctccagtaccctctgaactcctccaagcagacgttgtttcctgcagacatcgctggaaccattctggttaacacagagtgggaactcagtacacatttgtgaagtgaactcctggaagagctcttgtgagggaggcaccgaattatcaggcagctcaagagatagattcactctcctgaaattagagatgggatgcccttaatacaattcattccacccattaagtcttcaataaatgttcagcatatccagttaaaaaaaaaaagcttttcact

SEQ ID NO: 359211 - DNA, 1465 bp, Homo sapiens
gctaaagatgtgtatggaatgttctgaatgaaacagacttagtaagacatgagtgttgaaaagttttctcagttaatttagcagcactcaggactgctttgtccatgcagatacggctgacttactggggacttttgtttctaacattagccaagcttactgtcaactctgaagagatgttggagttgtcctagaacacttaaacttggaagttaaattgtctttcaatgtgtttggcagagttataaaagtagacatgagccatattgatagcggcacggcatatgaagagcttcagaatacttatgacacttctttgacgttctgtgaaaggctatagataagtacctccaaacatcatgcctccagcctcactcttgcttaaggaaatactctgaaagtagattttctttcttttttgagacagtctctctgtctcccaggctggagtgcagtggcatgatcttggttcactgcagcctccacctcctgggttcaaccgattctccttcttcagcctcccgagtagctgggattacaggtgcccaccaccacgcctggctaatttttgttcttttagtagagacggggatttggttgcgccatgttggccaggctggtctcaaactcctgaccgcaagtgatccgcccacctcggcctcccaaagtgctgggattacgggcatgagttactgcgcccagccaaatatctgttcttttagctctttgatagttcctttgtagtgacaaattattttttaaaagcttataaattggtgtttctgtggaagatgttatttctcatcgaatgcgtattgatagtgttttaagtttagaccacaaagtatttgtcttccatgtgcctgatatttacatagtactctaagctgcactgttgagtactgtagcatctagcttatatggctatttaaatttatattaggctaaaaattcaccagtgcagccatatttcaagttttcagtggctgtgagtggccaatggctctgttgtattggacagtacagatataggacatatgcagaaattatcattggacaaccctgctgtagaatgtcaccagtgtttctggaatcactgttttcgtgcttgaagtattttgtgctccactttgaaatgctaggaaatcgtgtcttcccttcacattgtaaactcttggtgattattgtggtctttggaggtgaagcccttgggcagaattgggatgggagtggaaagtaaactgctttgctgtggactagaagtagaattgggatgaggtgttcccgttctcatgagtcccttccctgtctgcactgttccctttccttgtgaacctttatttcccaaaccccttcttcaccttttccacctccagcctgtgcagaggcagatagatactggggacctgttgtactttgttctgcatcttcactagtggaaataagagttctcttaggctcactg

SEQ ID NO: 359212 - DNA, 1135 bp, Homo sapiens
gctaaagatgtgtatggaatgttctgaatgaaacagacttagtaagacatgagtgttgaaaagttttctcagttaatttagcagcactcaggactgctttgtccatgcagatacggctgacttactggggacttttgtttctaacattagccaagcttactgtcaactctgaagagatgttggagttgtcctagaacacttaaacttggaagttaaattgtctttcaatgtgtttggcagagttataaaagtagacatgagccatattgatagcggcacggcatatgaagagcttcagaatacttatgacacttctttgacgttctgtgaaaggctatagataagtacctccaaacatcatgcctccagcctcactcttgcttaaggaaatactctgaaagtagattttctttcttttttgagacagtctctctgtctcccaggctggagtgcagtggcatgatcttggttcactgcagcctccacctcctgggttcaaccgattctccttcttcagcctcccgagtagctgggattacaggtgcccaccaccacgcctggctaatttttgttcttttagtagagacggggatttggttgcgccatgttggccaggctggtctcaaactcctgaccgcaagtgatccgcccacctcggcctcccaaagtgctgggattacgggcatgagttactgcgcccagccaaatatctgttcttttagctctttgatagttcctttgtagtgacaaattattttttaaaagcttataaattggtgtttctgtggaagatgttatttctcatcgaatgcgtattgatagtgttttaagtttagaccacaaagtatttgtcttccatgtgcctgatatttacatagtactctaagctgcactgttgagtactgtagcatctagcttatatggctatttaaatttatattaggctaaaaattcaccagtgcagccatatttcaagttttcagtggctgtgagtggccaatggctctgttgtattggacagtacagatataggacatatgcagaaattatcattggacaaccctgctgtagaatgcaggggtgtctccggaccacgctcgcgcggggtcctctataacgccgcggcagcaagcgg

SEQ ID NO: 359213 - DNA, 467 bp, Homo sapiens
  misc_feature (112)..(114): n is a, c, g, or t
  misc_feature (117)..(117): n is a, c, g, or t
  misc_feature (119)..(120): n is a, c, g, or t
tgcaaagcttacaaatttattagcagcttgtgcagtaagtttcttttaatgcgtctgtggcaatactagcaataaattaataaaagcttaatttttatacaaatagttttannncananntgaattcttaagaaatacacatttaaagaaattacttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtata

SEQ ID NO: 359214 - DNA, 6430 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtata

SEQ ID NO: 359215 - DNA, 6612 bp, Homo sapiens
ttcgggagcctggcgtgggtgtctcagaactgatctgctttcagtctgagttttgccatcctctgcggcgagcctgcgagcttgcacacttgggcaggatgcgctcagcgccctagctcagaggccgacccagggcagagccagtcagcgggcgctgggacgcaggactctgaacatgggtcctctgcctccctcccacctcctccaggcccggccactcggcttcctggtgaggaattcttaacgaccgccaaatccggtttctagagataaaagacggttgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359216 - DNA, 6744 bp, Homo sapiens
ttcgggagcctggcgtgggtgtctcagaactgatctgctttcagtctgagttttgccatcctctgcggcgagcctgcgagcttgcacacttgggcaggatgcgctcagcgccctagctcagaggccgacccagggcagagccagtcagcgggcgctgggacgcaggactctgaacatgggtcctctgcctccctcccacctcctccaggcccggccactcggcttcctggtgaggaattcttaacgaccgccaaatccggtttctagagataaaagacggttgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggtaagtgatttttgaacttctgcctggatccatcatgaagacatgggcctcaccttattctttttatgactcagcatttactgtcagcattcagagcaagaaaatgttcacagtcctttcctttggccacaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359217 - DNA, 3136 bp, Homo sapiens
  misc_feature (2)..(2): n is a, c, g, or t
angcaggctgggtccggaattcccgggatcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359218 - DNA, 6377 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactccagcctcccttttcagagcacagcattaaagtttggggaattctgtaa

SEQ ID NO: 359219 - DNA, 3028 bp, Homo sapiens
aaagagaaggagggatcggagcccttgctgcagtttcctgtggtgtccctggaagctccctctgagcggtacctacaggatgaggcacgcctcatcccatctctgccgtccacgctggagattactgttctgctgctgcgtttcccatcacctcaaactgtttttcttgttcaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359220 - DNA, 6478 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359221 - DNA, 2521 bp, Homo sapiens
gctttttaaatgaccccaggcgtggggatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359222 - DNA, 6461 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359223 - DNA, 2817 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359224 - DNA, 6115 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtcagtcattccgtttgtgattagtgtttaaaatcctgaaaatatttaatacagaataaaaccataagctccaagtacattttcactataataacccatact

SEQ ID NO: 359225 - DNA, 5818 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359226 - DNA, 5391 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgca

SEQ ID NO: 359227 - DNA, 1117 bp, Homo sapiens
aaaggtgcttagagcgatgtggttgggtgccagactgtaggacgcatattgatcctggtcttatctgtaactctactagcccctgatattgatgtgtgtttgtatcattgtcaatctcgtgacgccacagtgtctgggtccctatgcggttcgtgaccaaaatatctagcatagggtgttcaagtggtcgattagagctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359228 - DNA, 5573 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacactcggctgccattgggccccaatggcagccggcagcatgtacccttggtaaatggctcttatttttaagaatgtctttatatagagccagagtgcataccagtgtgattttgccattgccttccaactccagaaagaaaactaactttgccttctctagtacatgagcaccctggagatactaaaactcttattctgactaaatgtctttcaagagcagcctccagatttttctgcattcttgctaccttgttaacttgcagtgccttacagtttaccatcggctgccattgg

SEQ ID NO: 359229 - DNA, 848 bp, Homo sapiens
  misc_feature (112)..(114): n is a, c, g, or t
  misc_feature (117)..(117): n is a, c, g, or t
  misc_feature (119)..(120): n is a, c, g, or t
tgcaaagcttacaaatttattagcagcttgtgcagtaagtttcttttaatgcgtctgtggcaatactagcaataaattaataaaagcttaatttttatacaaatagttttannncananntgaattcttaagaaatacacatttaaagaaattacataaaaggccttagtagtcttagaaatgtttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359230 - DNA, 933 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgacatcgacaaccacgtaccaagccaccgcagctgctgccactctgctgcctgtacagaagaaactgaatctttttcatattctaataaatcaatccgagttttaaaaaaaaaaa

SEQ ID NO: 359231 - DNA, 451 bp, Homo sapiens
gaaaagggtgaagcaggtcctcctggcccacctggaattgtgagtaagagtgctgtccctgggtctgtgagagcgctgggggaggaaggagaggaccctgggtctgtgagagcactggggggaggaaggagaggaccctgggtctgtgagagcgctgggagaggaaggagaggagatgcagggcacacacccacagctgtctctagaattgcatttgttatgtaaagtggttcatgctacttgaaatgattttctaatttgttgtacggagtttcgtgtttattatttttattatattttgataatttctgcacatctttaaatcactgaaaatgaaaaggtttgcacatgaatgagaatattagcaacatatttgactcctttttttttttgaaatggagtcttgctctgttgcccaggctggagtgcagtggtgcgatcttggctcact

SEQ ID NO: 359232 - DNA, 205 bp, Homo sapiens
ccgggtacccaggactcataggccgccagggcccgcaggtaaacgctggcactattgtgagcctttatcttcactttccaattcaacccagaagtctgtttattctttcctagaataaaggactctgtactcaagggaaaaaaatcatttatgcttcttctgggtaaaaacacaatttagtggtttcctttatgttcatgatttt

SEQ ID NO: 359233 - DNA, 365 bp, Homo sapiens
ccacaaggttcacctggcttacctggagacaaaggtgcaaaaggagagaaagggcaggcaggcccacctggcataggcatcccagggctgcgaggtgaaaaggtaaccagcgctctgcgtggaaaggtccccttctcccagctcagtggagatgctgcctgagaaatgctcagcaaatatctcagcacactcaatgagccataacacacagggagtcccataaggcagcacaagtcgcctctccttccccttgtattcactacctctcccccaaggaagaatctagagactggtgagaggctaaggtgggagacagctgtcagtgggataaaacagagaggatggaggacgaagaggaatggcag

SEQ ID NO: 359234 - DNA, 187 bp, Homo sapiens
gagatttccgagcagggcaggagtgccatgtttctgacgtgctgtgagatgatggccaatggtctgtctctgtgtcgtgttttaggaagcctacgccgtccaccttgaaggcaggggagctgcgcacgcacgtcagccgctgccaagtctgtatgagaagaacataatgaagcctgactcagctaat

SEQ ID NO: 359235 - DNA, 6532 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359236 - DNA, 5429 bp, Homo sapiens
  misc_feature (87)..(87): n is a, c, g, or t
catttttttcacgtggattttgcttggatcttgccagagatatatatgcgtctgccaagaagaaaccttttgaaggttggcctttgnaggataggagaaagctggagctgatcgaatcggggccctggaagggatatgttccttctctggaagggcctgtgctcaggaagtcttaagttggtcagtgtggatgtgttagcagcagtgcttggcagagatatatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359237 - DNA, 3418 bp, Homo sapiens
  misc_feature (33)..(33): n is a, c, g, or t
tcgctcctctctatggtggcgaagccaaaaagntgtaaccgtttccgtagtaattgcaggtcccacggcccgtgacactcgatgaatggcgcacttctaaactcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359238 - DNA, 1790 bp, Homo sapiens
tgtctctgctccacttccaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359239 - DNA, 5948 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggaacggtctcagaactgtttgtttcaattggccatttaagtttagtagtaaaagacttggttaatgatacaatgcatcgtaaaaccttcagagggaaggagagtgttttgtggaccactttggtttctttttgcgtgtgcagttttaggtatagttttaaatcagtacttttaatggaacacttgacacaatttgtcacagatttg

SEQ ID NO: 359240 - DNA, 5716 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtata

SEQ ID NO: 359241 - DNA, 1231 bp, Homo sapiens
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagacgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 359242 - DNA, 304 bp, Homo sapiens
tgccaggaccaagtggaagagatgggctcccgggtcctcctggttcccctgggccccctgggcagcctggctacacaagtgagttccctcagaaatggtttaatgtggggtgcaagcagacaccagggtgccgggcagacccaggttgggggctgtgatagtcccccacagccagagtgtaatagaaaggcgtggattcttctaatcatccatattcctctaagggaatcttcagagaatgaaccatgctacaaaaagcaatagttaaaatttcaaaataaagctggtttaacggagtaaataa

SEQ ID NO: 359243 - DNA, 3731 bp, Homo sapiens
aacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359244 - DNA, 3736 bp, Homo sapiens
  misc_feature (634)..(636): n is a, c, g, or t
  misc_feature (642)..(643): n is a, c, g, or t
  misc_feature (657)..(658): n is a, c, g, or t
  misc_feature (700)..(700): n is a, c, g, or t
  misc_feature (702)..(702): n is a, c, g, or t
  misc_feature (706)..(706): n is a, c, g, or t
  misc_feature (708)..(708): n is a, c, g, or t
  misc_feature (710)..(710): n is a, c, g, or t
aacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagagcnnntgtgtnngtttgtggattatnnttttttttttttttttttttttttttatatatattttttttntntttntntnttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359245 - DNA, 3370 bp, Homo sapiens
ccaggatcagaattcctgtactccatccacgcctccactgcagccccttcgactccaccggggccctgaggcggctggggtggggctgtctgggccccagtgggggagacctggggtcaccagctcccccaacccttcctcgcactcgctggtactatgccctgccaccacaggtgaggggtacagagggaggagcagggcctggggtgaaggctgagggcaatggggggtggtgtggaactgtctgacttccccttccttgctcctccaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359246 - DNA, 3534 bp, Homo sapiens
aacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359247 - DNA, 3552 bp, Homo sapiens
tcctgggtagaggccgggaagccacggttctgggacctggaggaaagatcctaggccccttcgactccaccggggccctgaggcggctggggtggggctgtctgggccccagtgggggagacctggggtcaccagctcccccaacccttcctcgcactcgctggtactatgccctgccaccacaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggtgagaccctgacctctggcccctatgccccctgaccccttactaacctctccttgactccagatcctttccttgcttccaccccttcctgatccagctcctagcctcctccacctaccattttgattctccccttttccctttggtcgttacccttcaaaccctgtgcccctctggttccttggccacctgagatcctcagatccctgatattggaaggctgacctcacttgactatgaactttaacctctgacctctaccctgcaggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359248 - DNA, 3810 bp, Homo sapiens
aacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagagtgagagattcactggctggggggtggtttcttgggacttccacttttctctgatcctcccaatctcctgccactgcagggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359249 - DNA, 3848 bp, Homo sapiens
aacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggtgagcggagtgtctgggctggatgctggacttccctatccatgttccaggaaggggagggggaaaagtcaggggtccctgagttttggctcctgcagtttgagggctccttcccaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359250 - DNA, 3750 bp, Homo sapiens
aacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaagtttgagggctccttcccaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359251 - DNA, 3956 bp, Homo sapiens
aacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggcggcggcgaacaactctcctccccacggggcggcgcgcgacacccgacgccgacccagcacgcattgaggaagcagagacggagcgcaccccaccacaggggagcggagtctattattagaacggaaagagagagcgagagagacgcgcacgcgaggagcgcacagagaacagagcacaaaacgaaggagagcggaggcgcgtacgaacgcgcaagcgcacatgcgaggaagggagtgttgcggcgggagggagagaggagagagagcgcacacggagcgaccgcggaggggaggagcagagcgagcagagaagtcacagagggcgagcgacacaccgagaaacacccgccacacccgcgagcgcggcgcgggaaacgacaaacacagaggggtgagagggtgtgaggagaggggagggtagagtaaatggagaggagtatagaagtgggaggggaggagtatgagggtggaatgattatgattcgaagctggaggagtggtggattgaaagagatgtagagaggtggtgatggatttgagcaggtttggagggtaggactggtggcgggaggaagagggggaggat

SEQ ID NO: 359252 - DNA, 3756 bp, Homo sapiens
aacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagagtgagagattcactggctggggggtggtttcttgggacttccacttttctctgatcctcccaatctcctgccactgcagggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359253 - DNA, 3450 bp, Homo sapiens
aacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgaagctgactatcccagcctcggctaatgtattctacgccatggatggagcttcacacgatttcctcctgcggcagcggcgaaggtcctctactgctacacctggcgtcaccatgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359254 - DNA, 476 bp, Homo sapiens
ggctccagaatgaatgtcgtggctataacctccaacctgaccatgatatccagaggtggctacaggggctccggccactgacagaggctcagaggtgactggcgggtgaggttgggactccagggttctggccaggtgtgggggattggtgtcatgtcctgagctctgcctattgcccccctaacccagccatcgtgtatcctgtgaggtggagccacctggttccagtgaccctcctgccccacgggtgcttcggccaacattggtcatctcgcagtggacagagtgagagattcactggctggggggtggtttcttgggacttccacttttctctgatcctcccaatctcctgccactgcagggttttgggctctgttggggtccctaccccgcttgtgtcctgtgaccggcccagtactgggggagatgaggcgcctacaactcctgctcctctgctgactcggctggcccag

SEQ ID NO: 359255 - DNA, 3455 bp, Homo sapiens
accaagggcccccctattccacccttctgttgccccctcccccaaccttcctgcagaactcccttccggtcttcttgacacccacccacgtcccttccctgcccggttcccccgcgcctgcctgactctccacccccaccccaccccgtctctccccaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359256 - DNA, 4004 bp, Homo sapiens
  misc_feature (634)..(636): n is a, c, g, or t
  misc_feature (642)..(643): n is a, c, g, or t
  misc_feature (657)..(658): n is a, c, g, or t
  misc_feature (700)..(700): n is a, c, g, or t
  misc_feature (702)..(702): n is a, c, g, or t
  misc_feature (706)..(706): n is a, c, g, or t
  misc_feature (708)..(708): n is a, c, g, or t
  misc_feature (710)..(710): n is a, c, g, or t
aacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagagcnnntgtgtnngtttgtggattatnnttttttttttttttttttttttttttatatatattttttttntntttntntnttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggtgagaccctgacctctggcccctatgccccctgaccccttactaacctctccttgactccagatcctttccttgcttccaccccttcctgatccagctcctagcctcctccacctaccattttgattctccccttttccctttggtcgttacccttcaaaccctgtgcccctctggttccttggccacctgagatcctcagatccctgatattggaaggctgacctcacttgactatgaactttaacctctgacctctaccctgcaggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359257 - DNA, 4202 bp, Homo sapiens
aacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgagggagccttgggatggagttggggtgaaggatggtgtcttgttggactataaatgttgtctgaggtttgggcagccaaatggaattgaatgtagttttaattttgacctttggttttggcagttatgttttatttttaattttatcttctaaactctagtcttcaatagaagctgaaatttgttttattttgatggctattttgcattagttgctacaccttaaacttttggtcgccgtgttaaaatttcagaatcaacagcagtttccccacagggaagcagctctgtttcactgggcaccatgtgggctggcttatggggtataggaagccaccatattgggttttcctgttcattttaaagccttggacacaagtaacattttgtggttgggttcagtggctgagggtagaaggatgggaaatcatggctgattgattgctcttttggtctcctgttctgccaggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359258 - DNA, 1747 bp, Homo sapiens
agccaagtcgagaggagcaggagttgtaggcgcctcatctcccccagtactgggccggtcacaggacacaagcggggtagggaccccaacagagcccaaaacctctgtccactgcgagatgaccaatgttggccgaagcacccacagggctggatttctcagctgtctggtaaaccagtggcacttcactgccccagggtggctggctcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359259 - DNA, 3677 bp, Homo sapiens
aacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359260 - DNA, 3503 bp, Homo sapiens
aacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccatgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagca

SEQ ID NO: 359261 - DNA, 3728 bp, Homo sapiens
aacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccatgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggcggcggcgaacaactctcctccccacggggcggcgcgcgacacccgacgccgacccagcacgcattgaggaagcagagacggagcgcaccccaccacaggggagcggagtctattattagaacggaaagagagagcgagagagacgcgcacgcgaggagcgcacagagaacagagcacaaaacgaaggagagcggaggcgcgtacgaacgcgcaagcgcacatgcgaggaagggagtgttgcggcgggagggagagaggagagagagcgcacacggagcgaccgcggaggggaggagcagagcgagcagagaagtcacagagggcgagcgacacaccgagaaacacccgccacacccgcgagcgcggcgcgggaaacgacaaacacagaggggtgagagggtgtgaggagaggggagggtagagtaaatggagaggagtatagaagtgggaggggaggagtatgagggtggaatgattatgattcgaagctggaggagtggtggattgaaagagatgtagagaggtggtgatggatttgagcaggtttggagggtaggactggtggcgggaggaagagggggaggat

SEQ ID NO: 359262 - DNA, 477 bp, Homo sapiens
tcacatatttattactgaatccagccaaccaacgtgttcataacagattcagagaggaaaacacgtcgaaatctccagatagtggtgacattttcagcttgatatggtaacatgatcgtgaccttcagacagcataaatatgtgtgccatctcatgtgcaattccttatagacccagcttggttcttctccaatgtctccttttggagttgtacctgattttatttccagttttcatccgaatccactggggaatgggacgattttgcttttgtttcttggccaggaatcgcttaatcctgaaagtcttgtgagaagacatggcgagcagcggagtcaagaacacaccacgatggcggagaaaggaagagggctgaggctgtgcaaggtggctcatgcctgtaatcccagcactttgtgaggatcctttgagcccagaaattggagaccttcctaggcgacagagagagaccccatc

SEQ ID NO: 359263 - DNA, 590 bp, Homo sapiens
cgattgcacctgtaaccaaacttggtgatctcctgcaactgctctacctctggtttctcctaacatactacccacagcaacctcaaacaatgaagttttgtaccattatagagtcctcttattggaatggattagaggggaaggaagaaacttaagtcattataccaggaaaatcattccctcactattgcaagagttaggtttcataatctgcctttcaaagagcaattacaaaagcaataagtaattttgttgtaaggattacaaatacacctacatgataaattgggggccggggaggatggtcctaatgtggtaacttgggtcaaacttgccagtgagtcagacatgtatttgagaagtgctgcatctcagacagcttagatgcaagtgaaggagatacactttgagaaatggactgtagataccatgaagacgttgatgtccaagatgcatgtagagagtgaataaaattgttacttgaaatgtgagaatgggaaaaaagcaatattttgtattaatgtattatatatataatgttattttaaatatgcatgtgtaactaaagtaataaattagatattataact

SEQ ID NO: 359264 - DNA, 5632 bp, Homo sapiens
ttttcttgatacagtaagtatattaagaatataaacgggtttgataaaatgaacatttaaaaaacatggcaccaggctgattcttcttcctgcacaccttaatgcctaacttttgaaaggacttgagacataagaatcacaattttaaaaaattatagtttccatgccttcatggtggatcaatttccatagaagtctaccaaaatgacttatctccatcccagggaagcaactgcaagagggaaaatgaaaggaatgcagtctttctatgtaggcagagtggacttaagtgtgagtcagaaacaccgatttcagtttgtgcgctgcaacttgataacttgggtgatgtttggcttctcagaactttgggaggtgaatttgaaaaacaggtaatgccacactatatagttcagaggattacctcagcttacaaacagcaaatgagacgcaaatgtgagccataattcacatttctaagcagttggagccctgatatggcactggggttacaaacaagcggggaaaaatgtcaacccagtgatgtcatactcctaggccgggccctaagatttttttggaacctggcgggctgagcacaacagggaaagcctcagcaccctgacttggcacaatggtacccttaaggctctttgctcactcagttcttagtagctctcctaaagcatggtggtgttctcttccagttctctgcgtagactttgctatgcttctccgcccactgcttcatccagagaaacactcgtatccacagcctctccccactttccctcacgcacggctctagaaagacggggatagggcgcggcttaggctttatacaccttgccagccaatgaccgcgccgtctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccagtcggcagaccacagggcagcttgggactcccagcaggcaaatccccaccatttgagagctcaccttgcagcagacagacatggtggctcggtacaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttttaaacttgctctttcccatttcctctaaagatgggtaaaataatgtcactccctaatttaagataggaattataaaaatttggtttatttagtctgttatatatgagaagcagagctaaaggaatatgcttttgttattttatgttttgttttgctttcttgaaatccagtggtaaaaagcacacactaggaaggatctaagctttctttaatataaaaaaaattatacttctctgaactgtttaatagagcaataattaaatacatcttctgat

SEQ ID NO: 359265 - DNA, 4173 bp, Homo sapiens
  misc_feature (1)..(1): n is a, c, g, or t
ncacacaacaccgaggaactgggtccatcgtctggagaatggttggacctaacagagttggaaaaaaaattggatgtggcattttggagaattccgattagggaaaaatttatacacaaatgaatatgtggcaattaagttggagcccatgaaatcagagcaccacagctacatttggaatacagattctataagcagttaggatctggagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccagtcggcagaccacagggcagcttgggactcccagcaggcaaatccccaccatttgagagctcaccttgcagcagacagacatggtggctcggtacaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttt

SEQ ID NO: 359266 - DNA, 5381 bp, Homo sapiens
ttttcttgatacagtaagtatattaagaatataaacgggtttgataaaatgaacatttaaaaaacatggcaccaggctgattcttcttcctgcacaccttaatgcctaacttttgaaaggacttgagacataagaatcacaattttaaaaaattatagtttccatgccttcatggtggatcaatttccatagaagtctaccaaaatgacttatctccatcccagggaagcaactgcaagagggaaaatgaaaggaatgcagtctttctatgtaggcagagtggacttaagtgtgagtcagaaacaccgatttcagtttgtgcgctgcaacttgataacttgggtgatgtttggcttctcagaactttgggaggtgaatttgaaaaacaggtaatgccacactatatagttcagaggattacctcagcttacaaacagcaaatgagacgcaaatgtgagccataattcacatttctaagcagttggagccctgatatggcactggggttacaaacaagcggggaaaaatgtcaacccagtgatgtcatactcctaggccgggccctaagatttttttggaacctggcgggctgagcacaacagggaaagcctcagcaccctgacttggcacaatggtacccttaaggctctttgctcactcagttcttagtagctctcctaaagcatggtggtgttctcttccagttctctgcgtagactttgctatgcttctccgcccactgcttcatccagagaaacactcgtatccacagcctctccccactttccctcacgcacggctctagaaagacggggatagggcgcggcttaggctttatacaccttgccagccaatgaccgcgccgtctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccagtcggcagaccacagggcagcttgggactcccagcaggcaaatccccaccatttgagagctcaccttgcagcagacagacatggtggctcggtacaggttgtaagttctacaaatggagagttaaacacagatgaccccaccgcaggacgttcaaatgcacccatcacagcccctactgaagtagaagtgatggatgaaaccaactgccagaaagtgttgaacatgtggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttt

SEQ ID NO: 359267 - DNA, 5261 bp, Homo sapiens
ttttcttgatacagtaagtatattaagaatataaacgggtttgataaaatgaacatttaaaaaacatggcaccaggctgattcttcttcctgcacaccttaatgcctaacttttgaaaggacttgagacataagaatcacaattttaaaaaattatagtttccatgccttcatggtggatcaatttccatagaagtctaccaaaatgacttatctccatcccagggaagcaactgcaagagggaaaatgaaaggaatgcagtctttctatgtaggcagagtggacttaagtgtgagtcagaaacaccgatttcagtttgtgcgctgcaacttgataacttgggtgatgtttggcttctcagaactttgggaggtgaatttgaaaaacaggtaatgccacactatatagttcagaggattacctcagcttacaaacagcaaatgagacgcaaatgtgagccataattcacatttctaagcagttggagccctgatatggcactggggttacaaacaagcggggaaaaatgtcaacccagtgatgtcatactcctaggccgggccctaagatttttttggaacctggcgggctgagcacaacagggaaagcctcagcaccctgacttggcacaatggtacccttaaggctctttgctcactcagttcttagtagctctcctaaagcatggtggtgttctcttccagttctctgcgtagactttgctatgcttctccgcccactgcttcatccagagaaacactcgtatccacagcctctccccactttccctcacgcacggctctagaaagacggggatagggcgcggcttaggctttatacaccttgccagccaatgaccgcgccgtctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttt

SEQ ID NO: 359268 - DNA, 4725 bp, Homo sapiens
ttttcttgatacagtaagtatattaagaatataaacgggtttgataaaatgaacatttaaaaaacatggcaccaggctgattcttcttcctgcacaccttaatgcctaacttttgaaaggacttgagacataagaatcacaattttaaaaaattatagtttccatgccttcatggtggatcaatttccatagaagtctaccaaaatgacttatctccatcccagggaagcaactgcaagagggaaaatgaaaggaatgcagtctttctatgtaggcagagtggacttaagtgtgagtcagaaacaccgatttcagtttgtgcgctgcaacttgataacttgggtgatgtttggcttctcagaactttgggaggtgaatttgaaaaacaggtaatgccacactatatagttcagaggattacctcagcttacaaacagcaaatgagacgcaaatgtgagccataattcacatttctaagcagttggagccctgatatggcactggggttacaaacaagcggggaaaaatgtcaacccagtgatgtcatactcctaggccgggccctaagatttttttggaacctggcgggctgagcacaacagggaaagcctcagcaccctgacttggcacaatggtacccttaaggctctttgctcactcagttcttagtagctctcctaaagcatggtggtgttctcttccagttctctgcgtagactttgctatgcttctccgcccactgcttcatccagagaaacactcgtatccacagcctctccccactttccctcacgcacggctctagaaagacggggatagggcgcggcttaggctttatacaccttgccagccaatgaccgcgccgtctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttt

SEQ ID NO: 359269 - DNA, 3935 bp, Homo sapiens
ttttcttgatacagtaagtatattaagaatataaacgggtttgataaaatgaacatttaaaaaacatggcaccaggctgattcttcttcctgcacaccttaatgcctaacttttgaaaggacttgagacataagaatcacaattttaaaaaattatagtttccatgccttcatggtggatcaatttccatagaagtctaccaaaatgacttatctccatcccagggaagcaactgcaagagggaaaatgaaaggaatgcagtctttctatgtaggcagagtggacttaagtgtgagtcagaaacaccgatttcagtttgtgcgctgcaacttgataacttgggtgatgtttggcttctcagaactttgggaggtgaatttgaaaaacaggtaatgccacactatatagttcagaggattacctcagcttacaaacagcaaatgagacgcaaatgtgagccataattcacatttctaagcagttggagccctgatatggcactggggttacaaacaagcggggaaaaatgtcaacccagtgatgtcatactcctaggccgggccctaagatttttttggaacctggcgggctgagcacaacagggaaagcctcagcaccctgacttggcacaatggtacccttaaggctctttgctcactcagttcttagtagctctcctaaagcatggtggtgttctcttccagttctctgcgtagactttgctatgcttctccgcccactgcttcatccagagaaacactcgtatccacagcctctccccactttccctcacgcacggctctagaaagacggggatagggcgcggcttaggctttatacaccttgccagccaatgaccgcgccgtctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactct

SEQ ID NO: 359270 - DNA, 2569 bp, Homo sapiens
acagacaccccacaacacccaaaacccacggccctcgttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttt

SEQ ID NO: 359271 - DNA, 3284 bp, Homo sapiens
ttttcttgatacagtaagtatattaagaatataaacgggtttgataaaatgaacatttaaaaaacatggcaccaggctgattcttcttcctgcacaccttaatgcctaacttttgaaaggacttgagacataagaatcacaattttaaaaaattatagtttccatgccttcatggtggatcaatttccatagaagtctaccaaaatgacttatctccatcccagggaagcaactgcaagagggaaaatgaaaggaatgcagtctttctatgtaggcagagtggacttaagtgtgagtcagaaacaccgatttcagtttgtgcgctgcaacttgataacttgggtgatgtttggcttctcagaactttgggaggtgaatttgaaaaacaggtaatgccacactatatagttcagaggattacctcagcttacaaacagcaaatgagacgcaaatgtgagccataattcacatttctaagcagttggagccctgatatggcactggggttacaaacaagcggggaaaaatgtcaacccagtgatgtcatactcctaggccgggccctaagatttttttggaacctggcgggctgagcacaacagggaaagcctcagcaccctgacttggcacaatggtacccttaaggctctttgctcactcagttcttagtagctctcctaaagcatggtggtgttctcttccagttctctgcgtagactttgctatgcttctccgcccactgcttcatccagagaaacactcgtatccacagcctctccccactttccctcacgcacggctctagaaagacggggatagggcgcggcttaggctttatacaccttgccagccaatgaccgcgccgtctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagaagttataaaaaaccagattaggtatataactggttgacacttaagatactgtactgctttctgtcgagc

SEQ ID NO: 359272 - DNA, 1675 bp, Homo sapiens
aagcagtggtatcaacgcagagtgcccattacggccgggtgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttt

SEQ ID NO: 359273 - DNA, 2155 bp, Homo sapiens
ttttcttgatacagtaagtatattaagaatataaacgggtttgataaaatgaacatttaaaaaacatggcaccaggctgattcttcttcctgcacaccttaatgcctaacttttgaaaggacttgagacataagaatcacaattttaaaaaattatagtttccatgccttcatggtggatcaatttccatagaagtctaccaaaatgacttatctccatcccagggaagcaactgcaagagggaaaatgaaaggaatgcagtctttctatgtaggcagagtggacttaagtgtgagtcagaaacaccgatttcagtttgtgcgctgcaacttgataacttgggtgatgtttggcttctcagaactttgggaggtgaatttgaaaaacaggtaatgccacactatatagttcagaggattacctcagcttacaaacagcaaatgagacgcaaatgtgagccataattcacatttctaagcagttggagccctgatatggcactggggttacaaacaagcggggaaaaatgtcaacccagtgatgtcatactcctaggccgggccctaagatttttttggaacctggcgggctgagcacaacagggaaagcctcagcaccctgacttggcacaatggtacccttaaggctctttgctcactcagttcttagtagctctcctaaagcatggtggtgttctcttccagttctctgcgtagactttgctatgcttctccgcccactgcttcatccagagaaacactcgtatccacagcctctccccactttccctcacgcacggctctagaaagacggggatagggcgcggcttaggctttatacaccttgccagccaatgaccgcgccgtctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattaggtaagactattttgtttattccattatgttagaaacattttaaaaattggaagatactttttaatgaaaatgatttagttatttaattgtttagttgtttaatggttgtggtaattttaaagaataaagatgttggaaatttcttttgtagttgtattttcatgtgtaaggaattccctagtataggagtgtctactttagccatccagagattgactatccagattatgagaaaacaaacaattaaattaaaatagcccagtaggctgaaatagctgccagtaaagcctttgcaatgttctttaggaatgatatttaggccactttttcagatt

SEQ ID NO: 359274 - DNA, 1011 bp, Homo sapiens
ttgtacgttttttttgccaatagaagcaaaaacctatgctttagttaaatgtattatgtgctttttttcagagtacagttttatataatgtatctttaaaatcaattactggcagaatctgatttttttttctttttcaagggaaaaatttatacacaaatgaatatgtggcaattaagttggagcccatgaaatcagagcaccacagctacatttggaatacagattctataagcagttaggatctggagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattaggtaagactattttgtttattccattatgttagaaacattttaaaaattggaagatactttttaatgaaaatgatttagttatttaattgtttagttgtttaatggttgtggtaattttaaagaataaagatgttggaaatttcttttgtagttgtattttcatgtgtaaggaattccctagtataggagtgtctactttagccatccagagattgactatccagattatgagaaaacaaacaattaaattaaaatagcccagtaggctgaaatagctgccagtaaagcctttgcaatgttctttaggaatgatatttaggccactttttcagatt

SEQ ID NO: 359275 - DNA, 5357 bp, Homo sapiens
ttttcttgatacagtaagtatattaagaatataaacgggtttgataaaatgaacatttaaaaaacatggcaccaggctgattcttcttcctgcacaccttaatgcctaacttttgaaaggacttgagacataagaatcacaattttaaaaaattatagtttccatgccttcatggtggatcaatttccatagaagtctaccaaaatgacttatctccatcccagggaagcaactgcaagagggaaaatgaaaggaatgcagtctttctatgtaggcagagtggacttaagtgtgagtcagaaacaccgatttcagtttgtgcgctgcaacttgataacttgggtgatgtttggcttctcagaactttgggaggtgaatttgaaaaacaggtaatgccacactatatagttcagaggattacctcagcttacaaacagcaaatgagacgcaaatgtgagccataattcacatttctaagcagttggagccctgatatggcactggggttacaaacaagcggggaaaaatgtcaacccagtgatgtcatactcctaggccgggccctaagatttttttggaacctggcgggctgagcacaacagggaaagcctcagcaccctgacttggcacaatggtacccttaaggctctttgctcactcagttcttagtagctctcctaaagcatggtggtgttctcttccagttctctgcgtagactttgctatgcttctccgcccactgcttcatccagagaaacactcgtatccacagcctctccccactttccctcacgcacggctctagaaagacggggatagggcgcggcttaggctttatacaccttgccagccaatgaccgcgccgtctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccagtcggcagaccacagggcagcttgggactcccagcaggcaaatccccaccatttgagagctcaccttgcagcagacagacatggtggctcggtacaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttt

SEQ ID NO: 359276 - DNA, 4213 bp, Homo sapiens
ttgtacgttttttttgccaatagaagcaaaaacctatgctttagttaaatgtattatgtgctttttttcagagtacagttttatataatgtatctttaaaatcaattactggcagaatctgatttttttttctttttcaagggaaaaatttatacacaaatgaatatgtggcaattaagttggagcccatgaaatcagagcaccacagctacatttggaatacagattctataagcagttaggatctggagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccagtcggcagaccacagggcagcttgggactcccagcaggcaaatccccaccatttgagagctcaccttgcagcagacagacatggtggctcggtacaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttt

SEQ ID NO: 359277 - DNA, 4529 bp, Homo sapiens
ttttcttgatacagtaagtatattaagaatataaacgggtttgataaaatgaacatttaaaaaacatggcaccaggctgattcttcttcctgcacaccttaatgcctaacttttgaaaggacttgagacataagaatcacaattttaaaaaattatagtttccatgccttcatggtggatcaatttccatagaagtctaccaaaatgacttatctccatcccagggaagcaactgcaagagggaaaatgaaaggaatgcagtctttctatgtaggcagagtggacttaagtgtgagtcagaaacaccgatttcagtttgtgcgctgcaacttgataacttgggtgatgtttggcttctcagaactttgggaggtgaatttgaaaaacaggtaatgccacactatatagttcagaggattacctcagcttacaaacagcaaatgagacgcaaatgtgagccataattcacatttctaagcagttggagccctgatatggcactggggttacaaacaagcggggaaaaatgtcaacccagtgatgtcatactcctaggccgggccctaagatttttttggaacctggcgggctgagcacaacagggaaagcctcagcaccctgacttggcacaatggtacccttaaggctctttgctcactcagttcttagtagctctcctaaagcatggtggtgttctcttccagttctctgcgtagactttgctatgcttctccgcccactgcttcatccagagaaacactcgtatccacagcctctccccactttccctcacgcacggctctagaaagacggggatagggcgcggcttaggctttatacaccttgccagccaatgaccgcgccgtctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccagtcggcagaccacagggcagcttgggactcccagcaggcaaatccccaccatttgagagctcaccttgcagcagacagacatggtggctcggtacaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtgatatctcattgtggtttgaagctgcattttctaatggctaatgtggcagaacatcttttcatgtgcttattttgccatctgtacaccctcaggtgaaatagctcttcaaatctcccat

SEQ ID NO: 359278 - DNA, 5207 bp, Homo sapiens
ttttcttgatacagtaagtatattaagaatataaacgggtttgataaaatgaacatttaaaaaacatggcaccaggctgattcttcttcctgcacaccttaatgcctaacttttgaaaggacttgagacataagaatcacaattttaaaaaattatagtttccatgccttcatggtggatcaatttccatagaagtctaccaaaatgacttatctccatcccagggaagcaactgcaagagggaaaatgaaaggaatgcagtctttctatgtaggcagagtggacttaagtgtgagtcagaaacaccgatttcagtttgtgcgctgcaacttgataacttgggtgatgtttggcttctcagaactttgggaggtgaatttgaaaaacaggtaatgccacactatatagttcagaggattacctcagcttacaaacagcaaatgagacgcaaatgtgagccataattcacatttctaagcagttggagccctgatatggcactggggttacaaacaagcggggaaaaatgtcaacccagtgatgtcatactcctaggccgggccctaagatttttttggaacctggcgggctgagcacaacagggaaagcctcagcaccctgacttggcacaatggtacccttaaggctctttgctcactcagttcttagtagctctcctaaagcatggtggtgttctcttccagttctctgcgtagactttgctatgcttctccgcccactgcttcatccagagaaacactcgtatccacagcctctccccactttccctcacgcacggctctagaaagacggggatagggcgcggcttaggctttatacaccttgccagccaatgaccgcgccgtctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttt

SEQ ID NO: 359279 - DNA, 5085 bp, Homo sapiens
ttttcttgatacagtaagtatattaagaatataaacgggtttgataaaatgaacatttaaaaaacatggcaccaggctgattcttcttcctgcacaccttaatgcctaacttttgaaaggacttgagacataagaatcacaattttaaaaaattatagtttccatgccttcatggtggatcaatttccatagaagtctaccaaaatgacttatctccatcccagggaagcaactgcaagagggaaaatgaaaggaatgcagtctttctatgtaggcagagtggacttaagtgtgagtcagaaacaccgatttcagtttgtgcgctgcaacttgataacttgggtgatgtttggcttctcagaactttgggaggtgaatttgaaaaacaggtaatgccacactatatagttcagaggattacctcagcttacaaacagcaaatgagacgcaaatgtgagccataattcacatttctaagcagttggagccctgatatggcactggggttacaaacaagcggggaaaaatgtcaacccagtgatgtcatactcctaggccgggccctaagatttttttggaacctggcgggctgagcacaacagggaaagcctcagcaccctgacttggcacaatggtacccttaaggctctttgctcactcagttcttagtagctctcctaaagcatggtggtgttctcttccagttctctgcgtagactttgctatgcttctccgcccactgcttcatccagagaaacactcgtatccacagcctctccccactttccctcacgcacggctctagaaagacggggatagggcgcggcttaggctttatacaccttgccagccaatgaccgcgccgtctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttt

SEQ ID NO: 359280 - DNA, 5109 bp, Homo sapiens
ttttcttgatacagtaagtatattaagaatataaacgggtttgataaaatgaacatttaaaaaacatggcaccaggctgattcttcttcctgcacaccttaatgcctaacttttgaaaggacttgagacataagaatcacaattttaaaaaattatagtttccatgccttcatggtggatcaatttccatagaagtctaccaaaatgacttatctccatcccagggaagcaactgcaagagggaaaatgaaaggaatgcagtctttctatgtaggcagagtggacttaagtgtgagtcagaaacaccgatttcagtttgtgcgctgcaacttgataacttgggtgatgtttggcttctcagaactttgggaggtgaatttgaaaaacaggtaatgccacactatatagttcagaggattacctcagcttacaaacagcaaatgagacgcaaatgtgagccataattcacatttctaagcagttggagccctgatatggcactggggttacaaacaagcggggaaaaatgtcaacccagtgatgtcatactcctaggccgggccctaagatttttttggaacctggcgggctgagcacaacagggaaagcctcagcaccctgacttggcacaatggtacccttaaggctctttgctcactcagttcttagtagctctcctaaagcatggtggtgttctcttccagttctctgcgtagactttgctatgcttctccgcccactgcttcatccagagaaacactcgtatccacagcctctccccactttccctcacgcacggctctagaaagacggggatagggcgcggcttaggctttatacaccttgccagccaatgaccgcgccgtctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaactgccagaaagtgttgaacatgtggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttt

SEQ ID NO: 359281 - DNA, 2878 bp, Homo sapiens
tttttttttctgttttaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatatatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttt

SEQ ID NO: 359282 - DNA, 3360 bp, Homo sapiens
ttttcttgatacagtaagtatattaagaatataaacgggtttgataaaatgaacatttaaaaaacatggcaccaggctgattcttcttcctgcacaccttaatgcctaacttttgaaaggacttgagacataagaatcacaattttaaaaaattatagtttccatgccttcatggtggatcaatttccatagaagtctaccaaaatgacttatctccatcccagggaagcaactgcaagagggaaaatgaaaggaatgcagtctttctatgtaggcagagtggacttaagtgtgagtcagaaacaccgatttcagtttgtgcgctgcaacttgataacttgggtgatgtttggcttctcagaactttgggaggtgaatttgaaaaacaggtaatgccacactatatagttcagaggattacctcagcttacaaacagcaaatgagacgcaaatgtgagccataattcacatttctaagcagttggagccctgatatggcactggggttacaaacaagcggggaaaaatgtcaacccagtgatgtcatactcctaggccgggccctaagatttttttggaacctggcgggctgagcacaacagggaaagcctcagcaccctgacttggcacaatggtacccttaaggctctttgctcactcagttcttagtagctctcctaaagcatggtggtgttctcttccagttctctgcgtagactttgctatgcttctccgcccactgcttcatccagagaaacactcgtatccacagcctctccccactttccctcacgcacggctctagaaagacggggatagggcgcggcttaggctttatacaccttgccagccaatgaccgcgccgtctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacagaagttataaaaaaccagattaggtatataactggttgacacttaagatactgtactgctttctgtcgagc

SEQ ID NO: 359283 - DNA, 3362 bp, Homo sapiens
  misc_feature (3198)..(3198): n is a, c, g, or t
  misc_feature (3229)..(3229): n is a, c, g, or t
  misc_feature (3270)..(3270): n is a, c, g, or t
ttttcttgatacagtaagtatattaagaatataaacgggtttgataaaatgaacatttaaaaaacatggcaccaggctgattcttcttcctgcacaccttaatgcctaacttttgaaaggacttgagacataagaatcacaattttaaaaaattatagtttccatgccttcatggtggatcaatttccatagaagtctaccaaaatgacttatctccatcccagggaagcaactgcaagagggaaaatgaaaggaatgcagtctttctatgtaggcagagtggacttaagtgtgagtcagaaacaccgatttcagtttgtgcgctgcaacttgataacttgggtgatgtttggcttctcagaactttgggaggtgaatttgaaaaacaggtaatgccacactatatagttcagaggattacctcagcttacaaacagcaaatgagacgcaaatgtgagccataattcacatttctaagcagttggagccctgatatggcactggggttacaaacaagcggggaaaaatgtcaacccagtgatgtcatactcctaggccgggccctaagatttttttggaacctggcgggctgagcacaacagggaaagcctcagcaccctgacttggcacaatggtacccttaaggctctttgctcactcagttcttagtagctctcctaaagcatggtggtgttctcttccagttctctgcgtagactttgctatgcttctccgcccactgcttcatccagagaaacactcgtatccacagcctctccccactttccctcacgcacggctctagaaagacggggatagggcgcggcttaggctttatacaccttgccagccaatgaccgcgccgtctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagcagtatatccctatctggtnttataactctgtagagctatcaacaggattntcttctagtgatatcacagagaacgagtgccaatattaaangagtatctgagagtatatttggcactgatgatcagatactgtggactgatcatagcatatacatctctcggaatatgtcagcctgccaagct

SEQ ID NO: 359284 - DNA, 394 bp, Homo sapiens
  misc_feature (49)..(49): n is a, c, g, or t
  misc_feature (83)..(83): n is a, c, g, or t
  misc_feature (104)..(104): n is a, c, g, or t
  misc_feature (117)..(117): n is a, c, g, or t
aataagtaagctaaggtaatgtaagaagtttttcatagaagtgtataantggtcgtaacggaatcggggtagccgttcgaatnattaagacaaggaagttaaantaaggtctggtgncaaatatgtctgtaaagttcacctctattctaaagggagcaggccagtttgctccctgcaggaatgggctgaggttcgccagattttctcattcgtctaccaaatccaaaaatgcaagtatgtgtgagaattctttatcattatcatctaatttgacattaagttaaccatgtgggcaaattatcgcccttggtgaactgccacttgcaacctctggtctactcatttcttcctttatatgcatataaacctgtgtggctttaataggacattagta

SEQ ID NO: 359285 - DNA, 6345 bp, Homo sapiens
ctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacttataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggatttaaaaaaaaaaaaaaaaaaaaaaaactctttaggctccaattttaaatagaaacctttatttacaatgacatccaaaatggtcagcaaagcagtcacagctcaccatcccccataagtcatttcatgtggtttcaattctttgcaagataaagaataatttctatttttttaagcaacataatgtaaacttgattgaaactgaattcattctcaagagtataagtcaattcctgagaatttaaatattgctctcatattttattcttcgaaactccatatattagaaaggaagagagaaaacaccctgctcgtttattaacagtgtgccttggagttgaaaacaataaatcaatccttgaggttttgctcctaggaacctaattgtgaacaaaactcacagcttctgcaaataaaaagggaactgggcaggcatacatgtaactggcaatccattctgtttactttcagctgcacccacctctggatcaaagaacttctaggacatcaagccaattatcttctgtaataccctacccctaatatagatacccccaactcacctcagatattaaatactgataactaagtagcactgttattgatatttacacctttcaatccagatgcagtttagaaaagtggcatcataatatgaacattaacaatgtaacttccgtttattttttaaaggaagaaacatgtatctcctttatatcattctgatctttataaaatatatatattttatttatatatctttggattcagcaaaaaaaaaaaaaaaaagtaggtactggaaatatcccacattctaaaagcagatgaaaagattatactgttcacccaacagataccaaggtttgaaaaaatggggggtgctggggtgtgaggagag

SEQ ID NO: 359286 - DNA, 3837 bp, Homo sapiens
  misc_feature (7)..(7): n is a, c, g, or t
  misc_feature (65)..(65): n is a, c, g, or t
ccatggngtaaccgttcgtacgagaatcgctgtcctctccttgcggccgccagtgtggtggaatntgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggatttaaaaaaaaaaaaaaaaaaaaaaaactctttaggctccaattttaaatagaaacctttatttacaatgacatccaaaatggtcagcaaagcagtcacagctcaccatcccccataagtcatttcatgtggtttcaattctttgcaagataaagaataatttctatttttttaagcaacataatgtaaacttgattgaaactgaattcattctcaagagtataagtcaattcctgagaatttaaatattgctctcatattttattcttcgaaactccatatattagaaaggaagagagaaaacaccctgctcgtttattaacagtgtgccttggagttgaaaacaataaatcaatccttgaggttttgctcctaggaacctaattgtgaacaaaactcacagcttctgcaaataaaaagggaactgggcaggcatacatgtaactggcaatccattctgtttactttcagctgcacccacctctggatcaaagaacttctaggacatcaagccaattatcttctgtaataccctacccctaatatagatacccccaactcacctcagatattaaatactgataactaagtagcactgttattgatatttacacctttcaatccagatgcagtttagaaaagtggcatcataatatgaacattaacaatgtaacttccgtttattttttaaaggaagaaacatgtatctcctttatatcattctgatctttataaaatatatatattttatttatatatctttggattcagcaaaaaaaaaaaaaaaaagtaggtactggaaatatcccacattctaaaagcagatgaaaagattatactgttcacccaacagataccaaggtttgaaaaaatggggggtgctggggtgtgaggagag

SEQ ID NO: 359287 - DNA, 5537 bp, Homo sapiens
ctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacttataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacagctgcacccacctctggatcaaagaacttctaggacatcaagccaattatcttctgtaataccctacccctaatatagatacccccaactcacctcagatattaaatactgataactaagtagcactgttattgatatttacacctttcaatccagatgcagtttagaaaagtggcatcataatatgaacattaacaatgtaacttccgtttattttttaaaggaagaaacatgtatctcctttatatcattctgatctttataaaatatatatattttatttatatatctttggattcagcaaaaaaaaaaaaaaaaagtaggtactggaaatatcccacattctaaaagcagatgaaaagattatactgttcacccaacagataccaaggtttgaaaaaatggggggtgctggggtgtgaggagag

SEQ ID NO: 359288 - DNA, 6589 bp, Homo sapiens
ctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacttataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggtatttcgttttattattaaagcctaaacaaagttgggctatcttggcccatccttcagtctcatctctgtgagtctgcacctgttatcttgagaaactgcccttccctctggtctgcccgagaccaggatcacccaccaaagataggtgtcacctaggagaccttctttgtatagttctttggggactttttctttcttggtgatggttaacattcattctcctttgacacttgaaaacttaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggatttaaaaaaaaaaaaaaaaaaaaaaaactctttaggctccaattttaaatagaaacctttatttacaatgacatccaaaatggtcagcaaagcagtcacagctcaccatcccccataagtcatttcatgtggtttcaattctttgcaagataaagaataatttctatttttttaagcaacataatgtaaacttgattgaaactgaattcattctcaagagtataagtcaattcctgagaatttaaatattgctctcatattttattcttcgaaactccatatattagaaaggaagagagaaaacaccctgctcgtttattaacagtgtgccttggagttgaaaacaataaatcaatccttgaggttttgctcctaggaacctaattgtgaacaaaactcacagcttctgcaaataaaaagggaactgggcaggcatacatgtaactggcaatccattctgtttactttcagctgcacccacctctggatcaaagaacttctaggacatcaagccaattatcttctgtaataccctacccctaatatagatacccccaactcacctcagatattaaatactgataactaagtagcactgttattgatatttacacctttcaatccagatgcagtttagaaaagtggcatcataatatgaacattaacaatgtaacttccgtttattttttaaaggaagaaacatgtatctcctttatatcattctgatctttataaaatatatatattttatttatatatctttggattcagcaaaaaaaaaaaaaaaaagtaggtactggaaatatcccacattctaaaagcagatgaaaagattatactgttcacccaacagataccaaggtttgaaaaaatggggggtgctggggtgtgaggagag

SEQ ID NO: 359289 - DNA, 4686 bp, Homo sapiens
ctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacttataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgta

SEQ ID NO: 359290 - DNA, 2590 bp, Homo sapiens
ccagatccttaaatgccatccttgccaggcattgggtgtataagtaaacaaaaaattgaggtgactaggtggtggcaatcccgttctaagtaacctagaaatattcattctcagcagccttgaagcaaagcttcctcagctataggaccgattaggaagtcatgataaagaccatgatagctaagtgctaagatgagtttgttttgttctttaggggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggatttaaaaaaaaaaaaaaaaaaaaaaaactctttaggctccaattttaaatagaaacctttatttacaatgacatccaaaatggtcagcaaagcagtcacagctcaccatcccccataagtcatttcatgtggtttcaattctttgcaagataaagaataatttctatttttttaagcaacataatgtaaacttgattgaaactgaattcattctcaagagtataagtcaattcctgagaatttaaatattgctctcatattttattcttcgaaactccatatattagaaaggaagagagaaaacaccctgctcgtttattaacagtgtgccttggagttgaaaacaataaatcaatccttgaggttttgctcctaggaacctaattgtgaacaaaactcacagcttctgcaaataaaaagggaactgggcaggcatacatgtaactggcaatccattctgtttactttcagctgcacccacctctggatcaaagaacttctaggacatcaagccaattatcttctgtaataccctacccctaatatagatacccccaactcacctcagatattaaatactgataactaagtagcactgttattgatatttacacctttcaatccagatgcagtttagaaaagtggcatcataatatgaacattaacaatgtaacttccgtttattttttaaaggaagaaacatgtatctcctttatatcattctgatctttataaaatatatatattttatttatatatctttggattcagcaaaaaaaaaaaaaaaaagtaggtactggaaatatcccacattctaaaagcagatgaaaagattatactgttcacccaacagataccaaggtttgaaaaaatggggggtgctggggtgtgaggagag

SEQ ID NO: 359291 - DNA, 4064 bp, Homo sapiens
ctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacttataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggcagatgacctttaacaagctgtgattcctgagagaggaacacctgcaccaactgcccaggaaacacacggaattccgtctcatttcattgtcctcccttttgtccactcatgcattcaacaaacacttcctgagaacttacacctgaaaccatgttgactaaagatgaccccatcctcgctg

SEQ ID NO: 359292 - DNA, 1333 bp, Homo sapiens
aggccacaggttgaaagtgggctcatggtgaaacttggtccacattggacctatctcgggcaatccttggaaagggattttcaaaattttggccaatgggtgaaaaattgggttgatttacagtgatttaccagaattttaaccaaatttaacgcatcaaatttcctttcgcctttcagggtgcacaagtgttgggaaagtcgtcgaaagggggccttgtcggaatttcgccagcttgagaaaaggggatgtaatgcaaatcggttaaattgggattaccaggggttttcccagtggttttccctgtaaaacgcggtgtcaatgaatggccaatgaattcaatatagggccaattgtggcaagtagcgtcaaaatttggcttgaatttatatgctttttttattttttttttttttttttttttttttttttttttttttttttttttttttttttttttttttttttttttttcaattttaaatagaaacctttatttacaatgacatccaaaatggtcagcaaagcagtcacagctcaccatcccccataagtcatttcatgtggtttcaattctttgcaagataaagaataatttctatttttttaagcaacataatgtaaacttgattgaaactgaattcattctcaagagtataagtcaattcctgagaatttaaatattgctctcatattttattcttcgaaactccatatattagaaaggaagagagaaaacaccctgctcgtttattaacagtgtgccttggagttgaaaacaataaatcaatccttgaggttttgctcctaggaacctaattgtgaacaaaactcacagcttctgcaaataaaaagggaactgggcaggcatacatgtaactggcaatccattctgtttactttcagctgcacccacctctggatcaaagaacttctaggacatcaagccaattatcttctgtaataccctacccctaatatagatacccccaactcacctcagatattaaatactgataactaagtagcactgttattgatatttacacctttcaatccagatgcagtttagaaaagtggcatcataatatgaacattaacaatgtaacttccgtttattttttaaaggaagaaacatgtatctcctttatatcattctgatctttataaaatatatatattttatttatatatctttggattcagcaaaaaaaaaaaaaaaaagtaggtactggaaatatcccacattctaaaagcagatgaaaagattatactgttcacccaacagataccaaggtttgaaaaaatggggggtgctggggtgtgaggagag

SEQ ID NO: 359293 - DNA, 3810 bp, Homo sapiens
ctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacttataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcatgcaccagcgccaacaataacacgtactggtgcatgaggaccagtacgtgttattgcctgcaccagcgccaacaataacacgtactggtcctcgaattcgaccacactggcggccgcaaggag

SEQ ID NO: 359294 - DNA, 2691 bp, Homo sapiens
ctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacttataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggactgctaacacaagagagacatgacagttcgcccccagcgaggggatccttaga

SEQ ID NO: 359295 - DNA, 2607 bp, Homo sapiens
  misc_feature (2534)..(2534): n is a, c, g, or t
  misc_feature (2545)..(2545): n is a, c, g, or t
  misc_feature (2568)..(2568): n is a, c, g, or t
  misc_feature (2598)..(2599): n is a, c, g, or t
ctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacttataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtccgagcggaccggtccgctcgagacagaccggatttgcagcgtcaacggaccgctacggcacctccanccagagtttcnctctgcgcttcgcccgtgcccanggcatagttcaccgatctttcgaggtcctnnaacacgtg

SEQ ID NO: 359296 - DNA, 2273 bp, Homo sapiens
ctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacttataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggtaagctgcaacctttccagcctgggagtggctgtgtggcccagcagttagaggcccaactcaggagccagactacttgggttcagattgtgactcaggcacttaaaagtgtgaccttgagcattttacatacacctcctcctcagtttttcatctctcagccagggacagtggctcacgcctgtaatcccagcactttgggaggctaaggcaggtgaatcacttgagtccaggagttcaagaccagcctgggcaacatgacgagaccctgtctgtacgaaaaaaatacaaaacttagccgggtgtggtggcacatgcc

SEQ ID NO: 359297 - DNA, 416 bp, Homo sapiens
cattggaggctgacagggactaagagactggcaacctgtaaagttcacctctattctaaagggagcaggccagtttgctccctgcaggaatgggctgaggttcgccagattttctcattcgtctaccaaatccaaaaatgcaagtatgtgtgagaattctttatcattatcatctaatttgacattaagttaaccatgtgggcaaattatcgcccttggtgaactgccacttgcaacctctggtctactcatttcttcctttatatgcatataaacctgtgtggctttaataggacattagtaacaggtcacctaagcctttcttcggtgcttctagaattaaggtacagaatctttacatatcacaatctccttagccactattctgtccagatccttaaatgccatccttgcca

SEQ ID NO: 359298 - DNA, 1107 bp, Homo sapiens
ggcggcggcggcagcggcagcggcggcgcggagtcccctgcgcccagcggcccggccgggctgcggcagaggcggcggcggcgccccgctccgggtgaggttgccggggccgtgcgcgctgatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggtaagctgcaacctttccagcctgggagtggctgtgtggcccagcagttagaggcccaactcaggagccagactacttgggttcagattgtgactcaggcacttaaaagtgtgaccttgagcattttacatacacctcctcctcagtttttcatctctcagccagggacagtggctcacgcctgtaatcccagcactttgggaggctaaggcaggtgaatcacttgagtccaggagttcaagaccagcctgggcaacatgacgagaccctgtctgtacgaaaaaaatacaaaacttagccgggtgtggtggcacatgcc

SEQ ID NO: 359299 - DNA, 5935 bp, Homo sapiens
ctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacttataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctggctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaagcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggatttaaaaaaaaaaaaaaaaaaaaaaaactctttaggctccaattttaaatagaaacctttatttacaatgacatccaaaatggtcagcaaagcagtcacagctcaccatcccccataagtcatttcatgtggtttcaattctttgcaagataaagaataatttctatttttttaagcaacataatgtaaacttgattgaaactgaattcattctcaagagtataagtcaattcctgagaatttaaatattgctctcatattttattcttcgaaactccatatattagaaaggaagagagaaaacaccctgctcgtttattaacagtgtgccttggagttgaaaacaataaatcaatccttgaggttttgctcctaggaacctaattgtgaacaaaactcacagcttctgcaaataaaaagggaactgggcaggcatacatgtaactggcaatccattctgtttactttcagctgcacccacctctggatcaaagaacttctaggacatcaagccaattatcttctgtaataccctacccctaatatagatacccccaactcacctcagatattaaatactgataactaagtagcactgttattgatatttacacctttcaatccagatgcagtttagaaaagtggcatcataatatgaacattaacaatgtaacttccgtttattttttaaaggaagaaacatgtatctcctttatatcattctgatctttataaaatatatatattttatttatatatctttggattcagcaaaaaaaaaaaaaaaaagtaggtactggaaatatcccacattctaaaagcagatgaaaagattatactgttcacccaacagataccaaggtttgaaaaaatggggggtgctggggtgtgaggagag

SEQ ID NO: 359300 - DNA, 3550 bp, Homo sapiens
  misc_feature (7)..(7): n is a, c, g, or t
  misc_feature (65)..(65): n is a, c, g, or t
ccatggngtaaccgttcgtacgagaatcgctgtcctctccttgcggccgccagtgtggtggaatntgaatcgccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggatttaaaaaaaaaaaaaaaaaaaaaaaactctttaggctccaattttaaatagaaacctttatttacaatgacatccaaaatggtcagcaaagcagtcacagctcaccatcccccataagtcatttcatgtggtttcaattctttgcaagataaagaataatttctatttttttaagcaacataatgtaaacttgattgaaactgaattcattctcaagagtataagtcaattcctgagaatttaaatattgctctcatattttattcttcgaaactccatatattagaaaggaagagagaaaacaccctgctcgtttattaacagtgtgccttggagttgaaaacaataaatcaatccttgaggttttgctcctaggaacctaattgtgaacaaaactcacagcttctgcaaataaaaagggaactgggcaggcatacatgtaactggcaatccattctgtttactttcagctgcacccacctctggatcaaagaacttctaggacatcaagccaattatcttctgtaataccctacccctaatatagatacccccaactcacctcagatattaaatactgataactaagtagcactgttattgatatttacacctttcaatccagatgcagtttagaaaagtggcatcataatatgaacattaacaatgtaacttccgtttattttttaaaggaagaaacatgtatctcctttatatcattctgatctttataaaatatatatattttatttatatatctttggattcagcaaaaaaaaaaaaaaaaagtaggtactggaaatatcccacattctaaaagcagatgaaaagattatactgttcacccaacagataccaaggtttgaaaaaatggggggtgctggggtgtgaggagag

SEQ ID NO: 359301 - DNA, 6291 bp, Homo sapiens
ctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacttataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggatttaaaaaaaaaaaaaaaaaaaaaaaactctttaggctccaattttaaatagaaacctttatttacaatgacatccaaaatggtcagcaaagcagtcacagctcaccatcccccataagtcatttcatgtggtttcaattctttgcaagataaagaataatttctatttttttaagcaacataatgtaaacttgattgaaactgaattcattctcaagagtataagtcaattcctgagaatttaaatattgctctcatattttattcttcgaaactccatatattagaaaggaagagagaaaacaccctgctcgtttattaacagtgtgccttggagttgaaaacaataaatcaatccttgaggttttgctcctaggaacctaattgtgaacaaaactcacagcttctgcaaataaaaagggaactgggcaggcatacatgtaactggcaatccattctgtttactttcagctgcacccacctctggatcaaagaacttctaggacatcaagccaattatcttctgtaataccctacccctaatatagatacccccaactcacctcagatattaaatactgataactaagtagcactgttattgatatttacacctttcaatccagatgcagtttagaaaagtggcatcataatatgaacattaacaatgtaacttccgtttattttttaaaggaagaaacatgtatctcctttatatcattctgatctttataaaatatatatattttatttatatatctttggattcagcaaaaaaaaaaaaaaaaagtaggtactggaaatatcccacattctaaaagcagatgaaaagattatactgttcacccaacagataccaaggtttgaaaaaatggggggtgctggggtgtgaggagag

SEQ ID NO: 359302 - DNA, 4704 bp, Homo sapiens
ctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacttataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtatagggtggtatagggtggtatagagtggtatcagggtggtatag

SEQ ID NO: 359303 - DNA, 1857 bp, Homo sapiens
tcttttgttggttctgtggctcttcttctttgctggttttgctgtgtgtctgtttttgtgctgttggttttgtttgtttggttgctgtctgtcgcgtctcttcctttcgcgtctgctcttcggtctcagggcttgcgggtgggctgtgctttctgctcttttgtcttttgtcttgctctcgctgtgccgctctgtgtctgtggcgcgttgcctgttcgggtcgctttctctgctgtgttgttgtggttgttgtgttgtgtgtgttttcctgtcttgttctctggttcctcttgtttttgtgtctgcttgtgttttgctgtcttttttgtttttgtgttgtttctctgttggttgttgtgtcgtttctgcgctctcttttgctgtgttgtcgctttgttctttgtttgcgttgtttcttttgttgttgtcttcctccttgggtgtttctggtttttgtttgtttttgtttgtttttgctttgtgtgtgttggtgtgtgtggtgttgtgtgtttttctgttgtttctccccgtctggcgggggggctgtttgatttttttagtttctcgtggcgttctccttctgtgggtgcctccccctcttggtttatgatatagtccccccctatttttggcccccccgcgagtatctctcccctctctcgtgggaggtttttctctctctagacacactctctcggtgtgtgttctcccccgcgcgcgcggtctttttttttatatggtgtgggagagacccccgcgccgcgtttgtgtctctcttcgcgcccgcggtctctccttatggggacccgctggtgtttgtgccccgctgtttctccttctcctttttggggcgcccggcgcgcgcccaccgcgcgatgtggttgtgttagaagggccttttgtcgggggggcgcgcgggcggcgcgcgcgcgcacacgtggttgtgttttgttgttgtttgttgttttgttttttttgttttgttttgtttgtgtgttcaattttaaatagaaacctttatttacaatgacatccaaaatggtcagcaaagcagtcacagctcaccatcccccataagtcatttcatgtggtttcaattctttgcaagataaagaataatttctatttttttaagcaacataatgtaaacttgattgaaactgaattcattctcaagagtataagtcaattcctgagaatttaaatattgctctcatattttattcttcgaaactccatatattagaaaggaagagagaaaacaccctgctcgtttattaacagtgtgccttggagttgaaaacaataaatcaatccttgaggttttgctcctaggaacctaattgtgaacaaaactcacagcttctgcaaataaaaagggaactgggcaggcatacatgtaactggcaatccattctgtttactttcagctgcacccacctctggatcaaagaacttctaggacatcaagccaattatcttctgtaataccctacccctaatatagatacccccaactcacctcagatattaaatactgataactaagtagcactgttattgatatttacacctttcaatccagatgcagtttagaaaagtggcatcataatatgaacattaacaatgtaacttccgtttattttttaaaggaagaaacatgtatctcctttatatcattctgatctttataaaatatatatattttatttatatatctttggattcagcaaaaaaaaaaaaaaaaagtaggtactggaaatatcccacattctaaaagcagatgaaaagattatactgttcacccaacagataccaaggtttgaaaaaatggggggtgctggggtgtgaggagag

SEQ ID NO: 359304 - DNA, 3524 bp, Homo sapiens
ctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacttataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggtaagagcagcttgaggtcctggggaagagatgcagaggcctgcatgaggaggtggccctcccttaagctaaaactcaga

SEQ ID NO: 359305 - DNA, 2194 bp, Homo sapiens
ctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacttataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacaggtcctgagccgattaagaaatcagacccaagagtcagctgatgaaagtcaacactgcactctgatgaatctggtgaaggctgggtttgagggcatggcttccttctgagagcatttgggcttcctgactaaactccagagtgtgacagacttcccactgatgcaggtccacacctctcctccccgcgcagacaggacaagcctcctgaaaactagccctccccgggggcagctcagtccccagaggaaaagcaagggaagggattgggctatgcatgcccacttcggcccttcaaatccactaggcacatgctaggggtcagcaaaccacagccaatggacctaaccaggccctccatttgttttagtaaataaagttttattggaacatac

SEQ ID NO: 359306 - DNA, 372 bp, Homo sapiens
  misc_feature (29)..(30): n is a, c, g, or t
cttctactactaaattcgcggccgcgtcnncctccctatggattgttaagggccctgtgcatatttgcatgtagccaaagattcagtctcttgcaggaactctggttgtcaactggtgatcttgcctttgtcttttctcatagttctgcctgtggcgcctgtcactagcagtcaaataaggacaattttaccattctctcctgctgctctaatttttttttagtgccggtacatgaatttgttattctttataattccctttgaagttggaaatccaaggggaatctaaaaccgaccagatgtttctgctgctggaaaggaaagagagtaaggattaagtttaacaaaaacttggtctccagaaaaaaaaaa

SEQ ID NO: 359307 - DNA, 2823 bp, Homo sapiens
acatttcaaaaaaaatacatagactgatgtttcagacttgtgcagcataagcctacagggtacgaagaatgaactctgagaatgtttggagaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatctttta

SEQ ID NO: 359308 - DNA, 1506 bp, Homo sapiens
gggggaagtttaggagttgaggaaagaagattaaagagcgcgaggagacaaataaaaagaagtgttaagaattgcctttgggactctgaaggctgaagaattgatgaattgcaagtttgtgccccatagctgcacagactgcctgaagttacatttagagactgaaatcactgcaccttaaaaacaaaagattgagctgcactgtattcctggaaagcacctaccaaggcttcctattacctatttcacagcataagcctacagggtacgaagaatgaactctgagaatgtttggagaatgtttcatcattactaacaggatattcctcatgacattgctgtctgattcagaggatacatgtgcaggcttgttacctgggtatattgtgtgatgctgaggtttggggtatgtatgatcccatcacccaagtactgagcatgtactgaacagttagtttggttttttgttgttgttgttttgttgttgttttgagatggagtctcattttgtcacccaggctggattgcagtggtgcaatcttggctcactgcaacctccgtccccccggttcaagtgattcttgtgccttagcctcccaagtagctgggattacagatgcgcgccatcatacccagctaatttttgtatttttagtagagacagggtttcaccatgttgtccaggcttgtctcaaactcctggcctcaagtgatccacctgccttggcctcccaaagtactgggattacagatgtgagacaccgcgcccggccactaagaagactttgatttctcgtcacatcttttgataataaggatctggagccaaaggagaaacagaaactacttttaagaactttggagatccaagtttagtggactcttaagagcctgtattatttcttggatgacttatccagccctttgtagaatcagaactctcacaattttctttaaatcaaataaaacccaaggggttaagtggatctttaaaattatttccaggtcattctttcaataaacatttattggtttatttgttattatttcaacaaactatgtgacaggcaaacatgaactcatttctttctttctttttttttttttttttacctttcaactccttttatttatttacctatttattttccttaagcaagtaaatctccctatggattgttaagggccctgtgcatatttgcatgtagccaaagattcagtctcttgcaggaactctggttgtcaactggtgatcttgcctttgtcttttctcatagttctgcctgtggcgcctgtcactagcagtcaaataaggacaattttaccattctctcctgctgctctaatttttttttagtgccggtacatgaatttgttattctttataattccctttgaagttggaaatccaaggggaatctaaaaccgaccagatgtttctgctgctggaaaggaaagagagtaaggattaagtttaacaaaaacttggtctccagaaaaaaaaaa

SEQ ID NO: 359309 - DNA, 646 bp, Homo sapiens
ctgcatatgtattttctttacagcataagcctacagggtacgaagaatgaactctgagaatgtttggagaatgtttcatcattactaacaggatattcctcatgacattgctgtctggataattggtctggtggaagggtagatggttccagattaaacatgggaagagatgaatgtctagaagaaatgaatttgaaactgagatctaaaggacaagaatgatggacagaagtgaacaggctgtctcaggttcattgattgagagatgcttcttggctattcactgcttcaattgttattctccattttatggctgctccatgaaaatgaacaagaaaggcacggagatgatagagagcaagtttacatgatagaggaagaaagttgttaacatgggagatgggaaagaacattaataggtgatgtatattcttagaaaaaatgatgactgctgtggatgagttttatctcaattctgagcaggtagttagagggaatggttggaatttaactctggagtctgatggcctgggatactttgtagttttgtgatctacaaaataatgttacaatactatttttaaaaattgttatgaaaattatataagttcatatatataaactacttagcaaatgactcttagaa

SEQ ID NO: 359310 - DNA, 1462 bp, Homo sapiens
caagaacagtcatcatagagagacaggctctcagggtccgtcccttcatgtcatggtgctgtgttagatcactttcctctgctggattaatggtcagagaaaaagggaaacaaactgtacccaaaggaatccaattaaagcacttgaacttcactgacgtctatcctattgttttcttaacttcctaacctatggttaattattctgaccagtggaaagaaacagcataaacatgggaattatcttaaattccctactttgtttagtttgtaaaggcatcaaaattttactgtgcaggatggaatactaatttggtatagttgaaattttttttggctaatctttctatttcttctttactctcctcaccaaaggcactgccaggacttaccgtacaacactccttggcttctggaattttatctctgctcacagtctacattacaacattagttcattctgggcactttagcttccttgaatctccagttgatctcacacccatgcctatgatattcttctcctggttaatcaagaattctctatttctgctccgtcatccatgccactacaaataaaaagaagtgttaagaattgcctttgggactctgaaggctgaagagaattgatgaattgcaagtttgtgccccatagctgcacaggctccaccatgcggtgccgctctctttggagtctcctgaaggggaggagggccctcttggctgctcttctgactccaacagctggatgaagcctattcttgtcctacaggagccccactggaagtgaataagctcagttgccatatttggaccaaaattctcacatttgatactggaaggggtgaaaagagacctgttcaggggcagtgcccagtgaggagaccctcaaacgagaggcagagtccctcaagcctttgtacaatgccaccaagggtgctgccccttcttcaacagaacgtcctccttgcagggaggctgcagtgatgtcagagatgaatcacaggccagaggtgagagctggagaacagggaaactctcccagtccctgggagtggtcattacagactgggaaatcgctctccagctgatggtaaaggactgcaaatcctattcatgtgactcagggcctggtgtgccttctgggaagaaagcagaagagggttcctaactgtagaagggaaaaagtttccctttattcttccagccacgtggttcaataagcatgtacaagctctcaccaggccaggcactgtgcgggcaccagaaacattagatggatgacacaggtctgcccttggaagaaacattacgatggacctgacccaggtctgactgggaggctcctttcccggctccggactctgtgactcctttggggagccaatcttgcccaagtgcctttctacagagattgtcccaggctcccagccggcctgttcccgtccctgtcctggaactcc

SEQ ID NO: 359311 - DNA, 702 bp, Homo sapiens
caagaacagtcatcatagagagacaggctctcagggtccgtcccttcatgtcatggtgctgtgttagatcactttcctctgctggattaatggtcagagaaaaagggaaacaaactgtacccaaaggaatccaattaaagcacttgaacttcactgacgtctatcctattgttttcttaacttcctaacctatggttaattattctgaccagtggaaagaaacagcataaacatgggaattatcttaaattccctactttgtttagtttgtaaaggcatcaaaattttactgtgcaggatggaatactaatttggtatagttgaaattttttttggctaatctttctatttcttctttactctcctcaccaaaggcactgccaggacttaccgtacaacactccttggcttctggaattttatctctgctcacagtctacattacaacattagttcattctgggcactttagcttccttgaatctccagttgatctcacacccatgcctatgatattcttctcctggttaatcaagaattctctatttctgctccgtcatccatgccactacaaataaaaagaagtgttaagaattgcctttgggactctgaaggctgaagagaattgatgaattgcaagtttgtgccccatagctgcacagcctatgtctaagcacagctcatcttcacaaactgaagtgg

SEQ ID NO: 359312 - DNA, 4670 bp, Homo sapiens
tgaggagtataataacatcataattttggaactagaatatagaaaaaatctggttagaagtatcagacaaagaaaaactgttttttttctcttttaaggcaagtttatttagaagcattgattatttttatttttccctcctaataaaagattaagggtaactgctgtagtttcagtcccatattctatgaaatatcatcctgattgtgatggtagcttcttatgggatttatttctgttgttgtaccactatgtactatacgcattgcacctgttcacacagagtacattgcattgtgatgtttgtacagctagatgctttaaatgagaagccaatctcccttcttctaggttcctagcctattagttacttaattaagcttaattctgttttggtctgtaattttgtaagtctgcaattttgtatatggtctcgatttattaactgagcaatgatttcttctttgcagttatcagttttgtctgagatcagttttcctattgtatggagtctgtttcttacagagcctcctttaagactgctctgactttaaaatcattactaggcttttgtcagagctgatttgttcacattcttctcacattaaaaataaatttaaaagattgcacaaataagctatgcatttcactatttcctgcttatatgcaaaaaatgtatttatgataattacatgtactgccagaactgaaacaatacattcctcataatggagcataaataaagaaggtggagccagctgctcttaaactgtttatttgcaagcaataatgatatagagaatatacctttttcactctgttagtctggcaatactgaacctgttgctgcattagacgagttgccttttgcctggataggggaaggagagctgtctgctgtctggtaggagggctttgtctgtgcctttctctctgtttctttctgtttttctttctctctctctctctctcctcttctctctctcttactcgcttgctctgtctctgtctctctctccctctcttcccccctccctcctctctcttgctctctctctctcttcccgtctctgtggtttgtaaggtaggttgcagtgtgtgtatatacacaacatcaagagcaggaaaatggactcattagggaggcaggcagtcattaccactcacactgtacttccagggagacaccgattataagaagagaaactcagcgctggggaagaagacaaataaaaagaagtgttaagaattgcctttgggactctgaaggctgaagactctcactctattggccaggctggagtgcagtggtgcaatctcggctcatggcaacttcttccgcttcctagtttcaagtgattctcctgcctcagcctcctgagtaactaggattacagaattgatgaattgcaagtttgtgccccatagctgcacagactgcctgaagttacatttagagactgaaatcactgcaccttaaaaacaaaagattgagctgcactgtattcctcataagcctacagggtacgaagaatgaactctgagaatgtttggagaatgtttcatcattactaacaggatattcctcatgacattgctgtctggttacatacagtgaattagacaaattaagtgtataccttgatgagtatacatgtgacaacacccaacccaaggtgcagaatatttataatacctaagaagaatcctttgtatgtgccccttgaaggtgaaattttccaaagttttaacaaaaggtaaagaacaagcaagttcaaaaaaggagagggaaagaaagaaagagaaatagagagagaggaatatctttgaccatcagtctgtgacctgccccttctctttacatgcagccgctctctgctccctgccccaatgaacatctgcactaggcccaagccttggagtaatttacctgaagagtgacaccattgattttgaaactactatgaggaaactgaagcccagagaggtgaagtgaggtgcccaaggccacacagcaagttagaggcacagctagtacggtagctcaagtctcctgactcccagtccagtgctcctcccattactccacgagtcctgtctctaagcttcctgacaaatgctagaacggaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatctttta

SEQ ID NO: 359313 - DNA, 2927 bp, Homo sapiens
agagggtgacaaagaaggtttttcaaagaggcagtggaggaggttctaataaatttggaaggaaacagttccctgtcttgggaaaaggagaactcctgactgattagcattcacaccagatgcagccgctctctgctccctgccccaatgaacatctgcactaggcccaagccttggagtaatttacctgaagagtgacaccattgattttgaaactactatgaggaaactgaagcccagagaggtgaagtgaggtgcccaaggccacacagcaagttagaggcacagctagtacggtagctcaagtctcctgactcccagtccagtgctcctcccattactccacgagtcctgtctctaagcttcctgacaaatgctagaacggaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatctttta

SEQ ID NO: 359314 - DNA, 3538 bp, Homo sapiens
gcagggagcttaacagccaggcctggacaccctcaagagactgtgtgctgattctcagtcgtcactccttggatcaggaaccatagtcctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaagtaaaaaaaaaaaaaaaatttccacttgtgaagagcactacaaaaaatatataacaaaatctaaaaggcctactgtctttaagtacaccgcttgcagtgtttcagtggacattttcacaattctggccgcttggacttcacagtaaccagttaaaactgtggaatatcacttctggttgaaaacccagaggaaaggccctgctgttttccacctaccacgttgtctgatttcataaaagggctgtgggggtgggaagggcagtgggttcggtggtgtgggaaagaaagacgaatggcaggcttcttccccagattctgcccgggtccacacaccctggcccaccttctccatatccccctcttgcagcagaagccaggaagacttggacaagcaacaagcaacagtggctatcgtatttattcagtgtcttcgctgagccacagcctcagcacaatcaagagggactttcatgaaaggcaggaatgcagataaaacaaagatatcagaaatttgcacctatgtttctaggtacaagagaaggattatttccaacaatctttgcaaaaaaaaaaaaaagtgtcaggatatattcttgtggaagagaaaaagaaaaagaaatggagggtggggggaacaataaaaagttcttgaggcttttttaattcaaaattttatagaggggcaaaagtgacgtttaccagatagaatgctgatttttttaatatatttacaacagtatttgtgtaaaaaaaaaa

SEQ ID NO: 359315 - DNA, 4168 bp, Homo sapiens
tgaggagtataataacatcataattttggaactagaatatagaaaaaatctggttagaagtatcagacaaagaaaaactgttttttttctcttttaaggcaagtttatttagaagcattgattatttttatttttccctcctaataaaagattaagggtaactgctgtagtttcagtcccatattctatgaaatatcatcctgattgtgatggtagcttcttatgggatttatttctgttgttgtaccactatgtactatacgcattgcacctgttcacacagagtacattgcattgtgatgtttgtacagctagatgctttaaatgagaagccaatctcccttcttctaggttcctagcctattagttacttaattaagcttaattctgttttggtctgtaattttgtaagtctgcaattttgtatatggtctcgatttattaactgagcaatgatttcttctttgcagttatcagttttgtctgagatcagttttcctattgtatggagtctgtttcttacagagcctcctttaagactgctctgactttaaaatcattactaggcttttgtcagagctgatttgttcacattcttctcacattaaaaataaatttaaaagattgcacaaataagctatgcatttcactatttcctgcttatatgcaaaaaatgtatttatgataattacatgtactgccagaactgaaacaatacattcctcataatggagcataaataaagaaggtggagccagctgctcttaaactgtttatttgcaagcaataatgatatagagaatatacctttttcactctgttagtctggcaatactgaacctgttgctgcattagacgagttgccttttgcctggataggggaaggagagctgtctgctgtctggtaggagggctttgtctgtgcctttctctctgtttctttctgtttttctttctctctctctctctctcctcttctctctctcttactcgcttgctctgtctctgtctctctctccctctcttcccccctccctcctctctcttgctctctctctctcttcccgtctctgtggtttgtaaggtaggttgcagtgtgtgtatatacacaacatcaagagcaggaaaatggactcattagggaggcaggcagtcattaccactcacactgtacttccagggagacaccgattataagaagagaaactcagcgctggggaagaagacaaataaaaagaagtgttaagaattgcctttgggactctgaaggctgaagactctcactctattggccaggctggagtgcagtggtgcaatctcggctcatggcaacttcttccgcttcctagtttcaagtgattctcctgcctcagcctcctgagtaactaggattacagaattgatgaattgcaagtttgtgccccatagctgcacagactgcctgaagttacatttagagactgaaatcactgcaccttaaaaacaaaagattgagctgcactgtattcctaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactatgaggaaactgaagcccagagaggtgaagtgaggtgcccaaggccacacagcaagttagaggcacagctagtacggtagctcaagtctcctgactcccagtccagtgctcctcccattactccacgagtcctgtctctaagcttcctgacaaatgctagaacggaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccactgcgcgtaagtcgtacccttctctactcttttggacctatccaaccttcatcctatgttagctcttctatagccattggccttgcaattaacaacacgttcggtgtcattttacattgtggcatctgttcgtattcgctgatctcggcttcg

SEQ ID NO: 359316 - DNA, 2782 bp, Homo sapiens
tgaggagtataataacatcataattttggaactagaatatagaaaaaatctggttagaagtatcagacaaagaaaaactgttttttttctcttttaaggcaagtttatttagaagcattgattatttttatttttccctcctaataaaagattaagggtaactgctgtagtttcagtcccatattctatgaaatatcatcctgattgtgatggtagcttcttatgggatttatttctgttgttgtaccactatgtactatacgcattgcacctgttcacacagagtacattgcattgtgatgtttgtacagctagatgctttaaatgagaagccaatctcccttcttctaggttcctagcctattagttacttaattaagcttaattctgttttggtctgtaattttgtaagtctgcaattttgtatatggtctcgatttattaactgagcaatgatttcttctttgcagttatcagttttgtctgagatcagttttcctattgtatggagtctgtttcttacagagcctcctttaagactgctctgactttaaaatcattactaggcttttgtcagagctgatttgttcacattcttctcacattaaaaataaatttaaaagattgcacaaataagctatgcatttcactatttcctgcttatatgcaaaaaatgtatttatgataattacatgtactgccagaactgaaacaatacattcctcataatggagcataaataaagaaggtggagccagctgctcttaaactgtttatttgcaagcaataatgatatagagaatatacctttttcactctgttagtctggcaatactgaacctgttgctgcattagacgagttgccttttgcctggataggggaaggagagctgtctgctgtctggtaggagggctttgtctgtgcctttctctctgtttctttctgtttttctttctctctctctctctctcctcttctctctctcttactcgcttgctctgtctctgtctctctctccctctcttcccccctccctcctctctcttgctctctctctctcttcccgtctctgtggtttgtaaggtaggttgcagtgtgtgtatatacacaacatcaagagcaggaaaatggactcattagggaggcaggcagtcattaccactcacactgtacttccagggagacaccgattataagaagagaaactcagcgctggggaagaagacaaataaaaagaagtgttaagaattgcctttgggactctgaaggctgaagactctcactctattggccaggctggagtgcagtggtgcaatctcggctcatggcaacttcttccgcttcctagtttcaagtgattctcctgcctcagcctcctgagtaactaggattacagaattgatgaattgcaagtttgtgccccatagctgcacagactgcctgaagttacatttagagactgaaatcactgcaccttaaaaacaaaagattgagctgcactgtattcctggaaagcacctaccaaggcttcctattacctatttcacagcataagcctacagggtacgaagaatgaactctgagaatgtttggagaatgtttcatcattactaacaggatattcctcatgacattgctgtctgattcagaggatacatgtgcaggcttgttacctgggtatattgtgtgatgctgaggtttggggtatgtatgatcccatcacccaagtactgagcatgtactgaacagttagtttggttttttgttgttgttgttttgttgttgttttgagatggagtctcattttgtcacccaggctggattgcagtggtgcaatcttggctcactgcaacctccgtccccccggttcaagtgattcttgtgccttagcctcccaagtagctgggattacagatgcgcgccatcatacccagctaatttttgtatttttagtagagacagggtttcaccatgttgtccaggcttgtctcaaactcctggcctcaagtgatccacctgccttggcctcccaaagtactgggattacagatgtgagacaccgcgcccggccactaagaagactttgatttctcgtcacatcttttgataataaggatctggagccaaaggagaaacagaaactacttttaagaactttggagatccaagtttagtggactcttaagagcctgtattatttcttggatgacttatccagccctttgtagaatcagaactctcacaattttctttaaatcaaataaaacccaaggggttaagtggatctttaaaattatttccaggtcattctttcaataaacatttattggtttatttgttattatttcaacaaactatgtgacaggcaaacatgaactcatttctttctttctttttttttttttttttacctttcaactccttttatttatttacctatttattttccttaagcaagtaaatctccctatggattgttaagggccctgtgcatatttgcatgtagccaaagattcagtctcttgcaggaactctggttgtcaactggtgatcttgcctttgtcttttctcatagttctgcctgtggcgcctgtcactagcagtcaaataaggacaattttaccattctctcctgctgctctaatttttttttagtgccggtacatgaatttgttattctttataattccctttgaagttggaaatccaaggggaatctaaaaccgaccagatgtttctgcttcatccttgtagcaatgcaggagctgctcaggcagggtt

SEQ ID NO: 359317 - DNA, 2048 bp, Homo sapiens
tgaggagtataataacatcataattttggaactagaatatagaaaaaatctggttagaagtatcagacaaagaaaaactgttttttttctcttttaaggcaagtttatttagaagcattgattatttttatttttccctcctaataaaagattaagggtaactgctgtagtttcagtcccatattctatgaaatatcatcctgattgtgatggtagcttcttatgggatttatttctgttgttgtaccactatgtactatacgcattgcacctgttcacacagagtacattgcattgtgatgtttgtacagctagatgctttaaatgagaagccaatctcccttcttctaggttcctagcctattagttacttaattaagcttaattctgttttggtctgtaattttgtaagtctgcaattttgtatatggtctcgatttattaactgagcaatgatttcttctttgcagttatcagttttgtctgagatcagttttcctattgtatggagtctgtttcttacagagcctcctttaagactgctctgactttaaaatcattactaggcttttgtcagagctgatttgttcacattcttctcacattaaaaataaatttaaaagattgcacaaataagctatgcatttcactatttcctgcttatatgcaaaaaatgtatttatgataattacatgtactgccagaactgaaacaatacattcctcataatggagcataaataaagaaggtggagccagctgctcttaaactgtttatttgcaagcaataatgatatagagaatatacctttttcactctgttagtctggcaatactgaacctgttgctgcattagacgagttgccttttgcctggataggggaaggagagctgtctgctgtctggtaggagggctttgtctgtgcctttctctctgtttctttctgtttttctttctctctctctctctctcctcttctctctctcttactcgcttgctctgtctctgtctctctctccctctcttcccccctccctcctctctcttgctctctctctctcttcccgtctctgtggtttgtaaggtaggttgcagtgtgtgtatatacacaacatcaagagcaggaaaatggactcattagggaggcaggcagtcattaccactcacactgtacttccagggagacaccgattataagaagagaaactcagcgctggggaagaagacaaataaaaagaagtgttaagaattgcctttgggactctgaaggctgaagactctcactctattggccaggctggagtgcagtggtgcaatctcggctcatggcaacttcttccgcttcctagtttcaagtgattctcctgcctcagcctcctgagtaactaggattacagaattgatgaattgcaagtttgtgccccatagctgcacagactgcctgaagttacatttagagactgaaatcactgcaccttaaaaacaaaagattgagctgcactgtattcctaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactacttctatgttactggaaaacgctaaacctgggagactaacatccctcttaggcttcagagaacccagatccagacctagaaatcaggagctgatgttgcctacagattacagagaagtccacaagtgagcatgtattcctgtcgtaggaagtatttcatctgtgcagaatgccagtgcctgcttttacttctcatgggccctagagaatggacagactgggttataatctttgcagtctttgctattcagaaacttggctttccaatgcataaaagagaaataataataataaaacagaaacttgctaggtgcaaaaatcaataaagaggataaaaaattaaaatgtg

SEQ ID NO: 359318 - DNA, 2173 bp, Homo sapiens
tgaggagtataataacatcataattttggaactagaatatagaaaaaatctggttagaagtatcagacaaagaaaaactgttttttttctcttttaaggcaagtttatttagaagcattgattatttttatttttccctcctaataaaagattaagggtaactgctgtagtttcagtcccatattctatgaaatatcatcctgattgtgatggtagcttcttatgggatttatttctgttgttgtaccactatgtactatacgcattgcacctgttcacacagagtacattgcattgtgatgtttgtacagctagatgctttaaatgagaagccaatctcccttcttctaggttcctagcctattagttacttaattaagcttaattctgttttggtctgtaattttgtaagtctgcaattttgtatatggtctcgatttattaactgagcaatgatttcttctttgcagttatcagttttgtctgagatcagttttcctattgtatggagtctgtttcttacagagcctcctttaagactgctctgactttaaaatcattactaggcttttgtcagagctgatttgttcacattcttctcacattaaaaataaatttaaaagattgcacaaataagctatgcatttcactatttcctgcttatatgcaaaaaatgtatttatgataattacatgtactgccagaactgaaacaatacattcctcataatggagcataaataaagaaggtggagccagctgctcttaaactgtttatttgcaagcaataatgatatagagaatatacctttttcactctgttagtctggcaatactgaacctgttgctgcattagacgagttgccttttgcctggataggggaaggagagctgtctgctgtctggtaggagggctttgtctgtgcctttctctctgtttctttctgtttttctttctctctctctctctctcctcttctctctctcttactcgcttgctctgtctctgtctctctctccctctcttcccccctccctcctctctcttgctctctctctctcttcccgtctctgtggtttgtaaggtaggttgcagtgtgtgtatatacacaacatcaagagcaggaaaatggactcattagggaggcaggcagtcattaccactcacactgtacttccagggagacaccgattataagaagagaaactcagcgctggggaagaagacaaataaaaagaagtgttaagaattgcctttgggactctgaaggctgaagactctcactctattggccaggctggagtgcagtggtgcaatctcggctcatggcaacttcttccgcttcctagtttcaagtgattctcctgcctcagcctcctgagtaactaggattacagaattgatgaattgcaagtttgtgccccatagctgcacagactgcctgaagttacatttagagactgaaatcactgcaccttaaaaacaaaagattgagctgcactgtattcctggaaagcacctaccaaggcttcctattacctatttcacagcataagcctacagggtacgaagaatgaactctgagaatgtttggagaatgtttcatcattactaacaggatattcctcatgacattgctgtctggataattggtctggtggaagggtagatggttccagattaaacatgggaagagatgaatgtctagaagaaatgaatttgaaactgagatctaaaggacaagaatgatggacagaagtgaacaggctgtctcaggttcattgattgagagatgcttcttggctattcactgcttcaattgttattctccattttatggctgctccatgaaaatgaacaagaaaggcacggagatgatagagagcaagtttacatgatagaggaagaaagttgttaacatgggagatgggaaagaacattaataggtgatgtatattcttagaaaaaatgatgactgctgtggatgagttttatctcaattctgagcaggtagttagagggaatggttggaatttaactctggagtctgatggcctgggatactttgtagttttgtgatctacaaaataatgttacaatactatttttaaaaattgttatgaaaattatataagttcatatatataaactacttagcaaatgactcttagaa

SEQ ID NO: 359319 - DNA, 1979 bp, Homo sapiens
tgaggagtataataacatcataattttggaactagaatatagaaaaaatctggttagaagtatcagacaaagaaaaactgttttttttctcttttaaggcaagtttatttagaagcattgattatttttatttttccctcctaataaaagattaagggtaactgctgtagtttcagtcccatattctatgaaatatcatcctgattgtgatggtagcttcttatgggatttatttctgttgttgtaccactatgtactatacgcattgcacctgttcacacagagtacattgcattgtgatgtttgtacagctagatgctttaaatgagaagccaatctcccttcttctaggttcctagcctattagttacttaattaagcttaattctgttttggtctgtaattttgtaagtctgcaattttgtatatggtctcgatttattaactgagcaatgatttcttctttgcagttatcagttttgtctgagatcagttttcctattgtatggagtctgtttcttacagagcctcctttaagactgctctgactttaaaatcattactaggcttttgtcagagctgatttgttcacattcttctcacattaaaaataaatttaaaagattgcacaaataagctatgcatttcactatttcctgcttatatgcaaaaaatgtatttatgataattacatgtactgccagaactgaaacaatacattcctcataatggagcataaataaagaaggtggagccagctgctcttaaactgtttatttgcaagcaataatgatatagagaatatacctttttcactctgttagtctggcaatactgaacctgttgctgcattagacgagttgccttttgcctggataggggaaggagagctgtctgctgtctggtaggagggctttgtctgtgcctttctctctgtttctttctgtttttctttctctctctctctctctcctcttctctctctcttactcgcttgctctgtctctgtctctctctccctctcttcccccctccctcctctctcttgctctctctctctcttcccgtctctgtggtttgtaaggtaggttgcagtgtgtgtatatacacaacatcaagagcaggaaaatggactcattagggaggcaggcagtcattaccactcacactgtacttccagggagacaccgattataagaagagaaactcagcgctggggaagaagacaaataaaaagaagtgttaagaattgcctttgggactctgaaggctgaagactctcactctattggccaggctggagtgcagtggtgcaatctcggctcatggcaacttcttccgcttcctagtttcaagtgattctcctgcctcagcctcctgagtaactaggattacagaattgatgaattgcaagtttgtgccccatagctgcacagactgcctgaagttacatttagagactgaaatcactgcaccttaaaaacaaaagattgagctgcactgtattcctcataagcctacagggtacgaagaatgaactctgagaatgtttggagaatgtttcatcattactaacaggatattcctcatgacattgctgtctggttacatacagtgaattagacaaattaagtgtataccttgatgagtatacatgtgacaacacccaacccaaggtgcagaatatttataatacctaagaagaatcctttgtatgtgccccttgaaggtgaaattttccaaagttttaacaaaaggtaaagaacaagcaagttcaaaaaaggagagggaaagaaagaaagagaaatagagagagaggaatatctttgaccatcagtctgtgacctgccccttctctttacggaactggtgtttttaatgtcatgtgaggacaacattacacaatggatctttggcagggatacacagaaatgaataccgtgtgcgaacaaacattaaatggcagtcttaattacaga

SEQ ID NO: 359320 - DNA, 161 bp, Homo sapiens
ttaaacgaagtttaataatttggaacatttgtttctgaacctattttttattattttattataggttacatacagtgaattagacaaattaagtgtataccttgatgagtatacatgtgacaacacccaacccaaggtgcagaatatttataatacctaag

SEQ ID NO: 359321 - DNA, 2739 bp, Homo sapiens
  misc_feature (3)..(3): n is a, c, g, or t
ggncagttgggaaacagcccagtggtataaggatgaggaaactgaagcccagagaggtgaagtgaggtgcccaaggccacacagcaagttagaggcacagctagtacggtagctcaagtctcctgactcccagtccagtgctcctcccattactccacgagtcctgtctctaagcttcctgacaaatgctagaacggaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatctttta

SEQ ID NO: 359322 - DNA, 4406 bp, Homo sapiens
tgaggagtataataacatcataattttggaactagaatatagaaaaaatctggttagaagtatcagacaaagaaaaactgttttttttctcttttaaggcaagtttatttagaagcattgattatttttatttttccctcctaataaaagattaagggtaactgctgtagtttcagtcccatattctatgaaatatcatcctgattgtgatggtagcttcttatgggatttatttctgttgttgtaccactatgtactatacgcattgcacctgttcacacagagtacattgcattgtgatgtttgtacagctagatgctttaaatgagaagccaatctcccttcttctaggttcctagcctattagttacttaattaagcttaattctgttttggtctgtaattttgtaagtctgcaattttgtatatggtctcgatttattaactgagcaatgatttcttctttgcagttatcagttttgtctgagatcagttttcctattgtatggagtctgtttcttacagagcctcctttaagactgctctgactttaaaatcattactaggcttttgtcagagctgatttgttcacattcttctcacattaaaaataaatttaaaagattgcacaaataagctatgcatttcactatttcctgcttatatgcaaaaaatgtatttatgataattacatgtactgccagaactgaaacaatacattcctcataatggagcataaataaagaaggtggagccagctgctcttaaactgtttatttgcaagcaataatgatatagagaatatacctttttcactctgttagtctggcaatactgaacctgttgctgcattagacgagttgccttttgcctggataggggaaggagagctgtctgctgtctggtaggagggctttgtctgtgcctttctctctgtttctttctgtttttctttctctctctctctctctcctcttctctctctcttactcgcttgctctgtctctgtctctctctccctctcttcccccctccctcctctctcttgctctctctctctcttcccgtctctgtggtttgtaaggtaggttgcagtgtgtgtatatacacaacatcaagagcaggaaaatggactcattagggaggcaggcagtcattaccactcacactgtacttccagggagacaccgattataagaagagaaactcagcgctggggaagaagacaaataaaaagaagtgttaagaattgcctttgggactctgaaggctgaagactctcactctattggccaggctggagtgcagtggtgcaatctcggctcatggcaacttcttccgcttcctagtttcaagtgattctcctgcctcagcctcctgagtaactaggattacagaattgatgaattgcaagtttgtgccccatagctgcacagactgcctgaagttacatttagagactgaaatcactgcaccttaaaaacaaaagattgagctgcactgtattcctaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactatgaggaaactgaagcccagagaggtgaagtgaggtgcccaaggccacacagcaagttagaggcacagctagtacggtagctcaagtctcctgactcccagtccagtgctcctcccattactccacgagtcctgtctctaagcttcctgacaaatgctagaacggaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatctttta

SEQ ID NO: 359323 - DNA, 4015 bp, Homo sapiens
caagaacagtcatcatagagagacaggctctcagggtccgtcccttcatgtcatggtgctgtgttagatcactttcctctgctggattaatggtcagagaaaaagggaaacaaactgtacccaaaggaatccaattaaagcacttgaacttcactgacgtctatcctattgttttcttaacttcctaacctatggttaattattctgaccagtggaaagaaacagcataaacatgggaattatcttaaattccctactttgtttagtttgtaaaggcatcaaaattttactgtgcaggatggaatactaatttggtatagttgaaattttttttggctaatctttctatttcttctttactctcctcaccaaaggcactgccaggacttaccgtacaacactccttggcttctggaattttatctctgctcacagtctacattacaacattagttcattctgggcactttagcttccttgaatctccagttgatctcacacccatgcctatgatattcttctcctggttaatcaagaattctctatttctgctccgtcatccatgccactacaaataaaaagaagtgttaagaattgcctttgggactctgaaggctgaagactctcactctattggccaggctggagtgcagtggtgcaatctcggctcatggcaacttcttccgcttcctagtttcaagtgattctcctgcctcagcctcctgagtaactaggattacagaattgatgaattgcaagtttgtgccccatagctgcacagactgcctgaagttacatttagagactgaaatcactgcaccttaaaaacaaaagattgagctgcactgtattcctcataagcctacagggtacgaagaatgaactctgagaatgtttggagaatgtttcatcattactaacaggatattcctcatgacattgctgtctggttacatacagtgaattagacaaattaagtgtataccttgatgagtatacatgtgacaacacccaacccaaggtgcagaatatttataatacctaagaagaatcctttgtatgtgccccttgaaggtgaaattttccaaagttttaacaaaaggtaaagaacaagcaagttcaaaaaaggagagggaaagaaagaaagagaaatagagagagaggaatatctttgaccatcagtctgtgacctgccccttctctttacatgcagccgctctctgctccctgccccaatgaacatctgcactaggcccaagccttggagtaatttacctgaagagtgacaccattgattttgaaactactatgaggaaactgaagcccagagaggtgaagtgaggtgcccaaggccacacagcaagttagaggcacagctagtacggtagctcaagtctcctgactcccagtccagtgctcctcccattactccacgagtcctgtctctaagcttcctgacaaatgctagaacggaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatctttta

SEQ ID NO: 359324 - DNA, 5169 bp, Homo sapiens
tgaggagtataataacatcataattttggaactagaatatagaaaaaatctggttagaagtatcagacaaagaaaaactgttttttttctcttttaaggcaagtttatttagaagcattgattatttttatttttccctcctaataaaagattaagggtaactgctgtagtttcagtcccatattctatgaaatatcatcctgattgtgatggtagcttcttatgggatttatttctgttgttgtaccactatgtactatacgcattgcacctgttcacacagagtacattgcattgtgatgtttgtacagctagatgctttaaatgagaagccaatctcccttcttctaggttcctagcctattagttacttaattaagcttaattctgttttggtctgtaattttgtaagtctgcaattttgtatatggtctcgatttattaactgagcaatgatttcttctttgcagttatcagttttgtctgagatcagttttcctattgtatggagtctgtttcttacagagcctcctttaagactgctctgactttaaaatcattactaggcttttgtcagagctgatttgttcacattcttctcacattaaaaataaatttaaaagattgcacaaataagctatgcatttcactatttcctgcttatatgcaaaaaatgtatttatgataattacatgtactgccagaactgaaacaatacattcctcataatggagcataaataaagaaggtggagccagctgctcttaaactgtttatttgcaagcaataatgatatagagaatatacctttttcactctgttagtctggcaatactgaacctgttgctgcattagacgagttgccttttgcctggataggggaaggagagctgtctgctgtctggtaggagggctttgtctgtgcctttctctctgtttctttctgtttttctttctctctctctctctctcctcttctctctctcttactcgcttgctctgtctctgtctctctctccctctcttcccccctccctcctctctcttgctctctctctctcttcccgtctctgtggtttgtaaggtaggttgcagtgtgtgtatatacacaacatcaagagcaggaaaatggactcattagggaggcaggcagtcattaccactcacactgtacttccagggagacaccgattataagaagagaaactcagcgctggggaagaagacaaataaaaagaagtgttaagaattgcctttgggactctgaaggctgaagactctcactctattggccaggctggagtgcagtggtgcaatctcggctcatggcaacttcttccgcttcctagtttcaagtgattctcctgcctcagcctcctgagtaactaggattacagaattgatgaattgcaagtttgtgccccatagctgcacagactgcctgaagttacatttagagactgaaatcactgcaccttaaaaacaaaagattgagctgcactgtattcctaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactatgaggaaactgaagcccagagaggtgaagtgaggtgcccaaggccacacagcaagttagaggcacagctagtacggtagctcaagtctcctgactcccagtccagtgctcctcccattactccacgagtcctgtctctaagcttcctgacaaatgctagaacggaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaagtaaaaaaaaaaaaaaaatttccacttgtgaagagcactacaaaaaatatataacaaaatctaaaaggcctactgtctttaagtacaccgcttgcagtgtttcagtggacattttcacaattctggccgcttggacttcacagtaaccagttaaaactgtggaatatcacttctggttgaaaacccagaggaaaggccctgctgttttccacctaccacgttgtctgatttcataaaagggctgtgggggtgggaagggcagtgggttcggtggtgtgggaaagaaagacgaatggcaggcttcttccccagattctgcccgggtccacacaccctggcccaccttctccatatccccctcttgcagcagaagccaggaagacttggacaagcaacaagcaacagtggctatcgtatttattcagtgtcttcgctgagccacagcctcagcacaatcaagagggactttcatgaaaggcaggaatgcagataaaacaaagatatcagaaatttgcacctatgtttctaggtacaagagaaggattatttccaacaatctttgcaaaaaaaaaaaaaagtgtcaggatatattcttgtggaagagaaaaagaaaaagaaatggagggtggggggaacaataaaaagttcttgaggcttttttaattcaaaattttatagaggggcaaaagtgacgtttaccagatagaatgctgatttttttaatatatttacaacagtatttgtgtaaaaaaaaaa

SEQ ID NO: 359325 - DNA, 4097 bp, Homo sapiens
tgaggagtataataacatcataattttggaactagaatatagaaaaaatctggttagaagtatcagacaaagaaaaactgttttttttctcttttaaggcaagtttatttagaagcattgattatttttatttttccctcctaataaaagattaagggtaactgctgtagtttcagtcccatattctatgaaatatcatcctgattgtgatggtagcttcttatgggatttatttctgttgttgtaccactatgtactatacgcattgcacctgttcacacagagtacattgcattgtgatgtttgtacagctagatgctttaaatgagaagccaatctcccttcttctaggttcctagcctattagttacttaattaagcttaattctgttttggtctgtaattttgtaagtctgcaattttgtatatggtctcgatttattaactgagcaatgatttcttctttgcagttatcagttttgtctgagatcagttttcctattgtatggagtctgtttcttacagagcctcctttaagactgctctgactttaaaatcattactaggcttttgtcagagctgatttgttcacattcttctcacattaaaaataaatttaaaagattgcacaaataagctatgcatttcactatttcctgcttatatgcaaaaaatgtatttatgataattacatgtactgccagaactgaaacaatacattcctcataatggagcataaataaagaaggtggagccagctgctcttaaactgtttatttgcaagcaataatgatatagagaatatacctttttcactctgttagtctggcaatactgaacctgttgctgcattagacgagttgccttttgcctggataggggaaggagagctgtctgctgtctggtaggagggctttgtctgtgcctttctctctgtttctttctgtttttctttctctctctctctctctcctcttctctctctcttactcgcttgctctgtctctgtctctctctccctctcttcccccctccctcctctctcttgctctctctctctcttcccgtctctgtggtttgtaaggtaggttgcagtgtgtgtatatacacaacatcaagagcaggaaaatggactcattagggaggcaggcagtcattaccactcacactgtacttccagggagacaccgattataagaagagaaactcagcgctggggaagaagacaaataaaaagaagtgttaagaattgcctttgggactctgaaggctgaagactctcactctattggccaggctggagtgcagtggtgcaatctcggctcatggcaacttcttccgcttcctagtttcaagtgattctcctgcctcagcctcctgagtaactaggattacagaattgatgaattgcaagtttgtgccccatagctgcacagactgcctgaagttacatttagagactgaaatcactgcaccttaaaaacaaaagattgagctgcactgtattcctaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactatgaggaaactgaagcccagagaggtgaagtgaggtgcccaaggccacacagcaagttagaggcacagctagtacggtagctcaagtctcctgactcccagtccagtgctcctcccattactccacgagtcctgtctctaagcttcctgacaaatgctagaacggaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcattaatcgcccggggggggaaaaggttaaccgtatt

SEQ ID NO: 359326 - DNA, 2106 bp, Homo sapiens
  misc_feature (358)..(358): n is a, c, g, or t
  misc_feature (1317)..(1317): n is a, c, g, or t
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggtctgtgcaaatgtattgccttctcttgagaattcttgttgcggggcgggagggaaacatagaatccccaccaaagctttcttggaaaactcccctgggggggctccaagatggcggagcccagagttcggtgggttggaggcgaggtccagctgtcctgggtgccaggaggacacccgagaccccaggcggtgagaaagggcggcagtccggggcncactgcttttccctggcctgtttttcttttgtctaagcaccccctgattctggctccagggaatcccgagggtaaggctacctcaaacgcttgagtttcggactcttcaatgggatatggcccgacgctgttttccccttattccccacgccttaaaccagccttcgaggtacaaaggagcgattccacatttcgccctctgaaactgatagcaatcgtaacatctgcggccccatccttgctctctcgttgctgttacaatcgcttgttctgtgggcggatgttgtaaaggagaaaagtgaaaaggaagagtgtttggttatgagctctatcctgccttgcgagcaggagcacgggggatctgagttaggagctagggtactggggcggtgagggctgggagaatggtgggaaggtattgaccaggtgatagatcaatcagcccaaggctggccaagtgccccagtgaatcagcagcgggctgtaaaaccggcagcctgcttattggttctaagtaaatcaccagtggtgacggaccagtgactgaatagacagacacactccttccccaggtgggcggtcttagtcccaatagaacttgaagccaggccagatcacagtcatttcttaccacagtcacctactttccttcttttatttttattttctcttccttctctggtgcccctcttccagttatattttttctgccttctgaacactcagttctcccacctctaggcacacatggtttctcacactcagatgaaaacactgctttttatctttttttcactacaagatcctcttatccacatagaatctcaatgaaaagttgaaccagaactgaaaatagtgctcataccccagagggatttttctggaaaaaaaaaaatatatgtgtgtatatatatatatatatgtgtgtgtgtgtatatatatatatgtgtgtgtgtatntatatatatatatatattccaggagctgtattcccaactcagcagggttatgggagtcgggccagagctggacttttatagttgtctctttcattcctgctggttaaggagaagaaagaactaagtacaggtcctactaagttgtcactcctggagctacatacagtaaggggatgtgggaaacagcctagaggcttgttttctgaggagggaggtgatggtttgtggggaccatgagttaatctgcctccctgtcagcattttcgcactatgcaggtagcttcaatggctaagagtatgtaccttgcaattccaagttcaatgaaaaaggctgaaatgctctttaagaatgcatctcctggtcaacagattgttttaaccagagtcccaacattgccaagaagagaataggccagtctgagaaccaccaatctgtgtttgtgcattcattcatttggaaaaggcaatatagtatagtacttagaaacaagcactctaggctgggcttggtgactcacacctgtaatcccagcactttgggaggctgaggtgggcggatcacctgaggtcaggagttcgagaccatcctggccagcgtggtgaaaccctgtctctactaaaaatacaaaaattagctgggcgtggtggcgcatgggtgagggggtgagggatgagaatcgcttgaacctgggagatgggggttgcagtggaggtggaggttgcagtgagccgagatcacaccattgcactccagcctgggcaacaagagcaaaactctgtctcaaaaaa

SEQ ID NO: 359327 - DNA, 2486 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359328 - DNA, 2498 bp, Homo sapiens
  misc_feature (2475)..(2476): n is a, c, g, or t
  misc_feature (2483)..(2483): n is a, c, g, or t
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcatcagacaatgtatgtnnatcctcnagagtcaaccgcaac

SEQ ID NO: 359329 - DNA, 2460 bp, Homo sapiens
ggaagtcggctaggtacgaggctgggtggttaccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359330 - DNA, 2447 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359331 - DNA, 2491 bp, Homo sapiens
ctctagctaccggtgggccgggcggagcccaggtagagctcatgtcctggttgtagctccttccttacgtgacctctccggtgcttgtaaaaataggtggcggcctaaactcacgggaaaatgctgtcccgtgtggggatgtgtacctcactgtgttcagttctccagggagatatgtagatggtcggttcactggatctatctaaccaggtatcggagaacggaagcatcaggaccatacagaagttagggctccacgagcagtgagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359332 - DNA, 1998 bp, Homo sapiens
ggaagtcggctaggtacgaggctgggtggttacgtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359333 - DNA, 2436 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagcctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359334 - DNA, 2178 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359335 - DNA, 1969 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccacactggtttttgttaagacctcatcagtcctgggtcgacgcggccagcaat

SEQ ID NO: 359336 - DNA, 1808 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359337 - DNA, 1680 bp, Homo sapiens
ggaagtcggctaggtacgaggctgggtggttaccggcagagatggttgagctcatgttcccgctgttgctcctccttctgcccttccttctgtatatggctgcgccccaaatcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359338 - DNA, 1619 bp, Homo sapiens
ggatggtgtgttttacccgcgcgtttgtttcagttacaaaaaaactttatcgaatgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359339 - DNA, 1795 bp, Homo sapiens
tcaaacaaagcattctgatgagaggtggtctagcgaggagatctaaaatggtaattacattttctctggctaaggactggagaatgaagagataaggacaaacactggccctgtgaagtacatggagaacatgtgatccctagttgtttttatgtcatattccttatccctggcagatggcagacttcattcttaacactgtgcttcatacctttctctttaccttccagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359340 - DNA, 1301 bp, Homo sapiens
actgcttcagccggccgccatgggaagggttttttgcgaaatccccccttttggccagaaaaccttatattaaccggaccaagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359341 - DNA, 1298 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggattgagggtcttcttatcctattatgtcgacgcgg

SEQ ID NO: 359342 - DNA, 1024 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagctggcagagatggaggaggagctacgttatgcacccctgtctttccgaaaccccatgatgtctaagcttcgaaactaccggaaggaccttgctaaactccatc

SEQ ID NO: 359343 - DNA, 983 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtccagttttctttattcttttttggattcctaattctattgttttacattaaaaagaattta

SEQ ID NO: 359344 - DNA, 968 bp, Homo sapiens
  misc_feature (22)..(23): n is a, c, g, or t
tactactactaaattcgcggcnngtcgaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359345 - DNA, 2547 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgattattttttgttttcatttaccagaataaaaactaagaattaaaagtttgattacagtcaaaag

SEQ ID NO: 359346 - DNA, 1143 bp, Homo sapiens
  misc_feature (298)..(298): n is a, c, g, or t
gcttaatataaaactcagatgaaacaatcgtgaggctgggaagaatgggacagttgaaacaataaatgcttgtcatctcagaagataagcattaaagatggagataaagaaaaattcatgagacagaagatctaggcaatgatttagaggaaacctcctcccaaaaaccccagaggaagaatatgacctgtgtttcaaattttgcctttctgaactatttaaaattatgtgtatgtttttgctttgtattttaaaagtaaagctgctgtcctcaagaaaaaaaaaaaaaaaaaaaaanaaaaaacaaaaaaaaaaaaaaaaaaaaaacaaaaaaaaaaaaaaaaacacagagaaagaaaaaaaaacaagacacaaagacgaggaaagaagagcgacgagaacgagaggacaagaagacgctgaaccacagaccggggcggggcgtgcccgtgctgccgcccggcgcgcgggggaaaaggaataacgagaagaacataaagatccagacacgaggaggagaagaaagtggggtgaagagacgaggagaccgaaagaccagagcgtatagcagtcgcgagcaggaaagacagaaaaaatgaaaacgaaacgatcttgatcagaacgagcataactaggagagatgtcggacaaaaaaagaaagagagggggtaaagttaaagaatatacaatgaaatagagagaaagaagagaagaagaaaagaaagaagtaagacagagcacaggagtcgcccgcccccccccccccgccccgcgcgactataaccagagaggaggcgaccaccaataagggaagaaaggagagacaacgcaaaacatgcaggggacgaagcggagcgaagaagaaaggagaaggagaagccgaagacagagaactagcggtcgaaggcaaggggcacacgcaacggccccacagggaggcacacagcagcgcaaagaaacggaaagagcgcgcagaggaagagaacaggagaaggagaggagacgcagaagacgagaggagaagaaacaacgacccaaagaagccaacaaacagaagcaaggcaaagaaaggacaaacaaagcgcaagagacacaaacagcgggggagggaaaaagccacgagggaacacacgcaaacaccga

SEQ ID NO: 359347 - DNA, 2874 bp, Homo sapiens
  misc_feature (2001)..(2001): n is a, c, g, or t
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaaaaaaaaaaaaaaaaaaaanaaaaaatttttttttaaaaaaatttaatcttaggggaagtggattagtgggtaaatttggtggtcaagctaataatataattatggggcgggcatttcccttataatgtggttttgggacaagaattaaaatggttgcgtgcgcccaaaattgtggttattatcattggggaagcactacttttatcaaagagttaggggtggcccaagggaaggttcatgaggaaattaagagggtgtcccatacacttgttgggggaagtggtggccatttcctaaaaacaaaattggaattccgcgtgggaagtggaaccaatttattttataccactgtgcggcgggggggaaagagaaagtttagtgaggaacccagcgaatttaacattcgggaaatacggtgaaacaattaactccttaaagtcgcaccgtgttggggacccattaagcgcctatttgtttttacaaaagtgggctccttttagggcaacatttcaaaaaactgggatagttgcgcaccaacaaagggcaataaagtgtaaacctacctttaatttggaacggttgtcagggacacatataccatcccctttgggctcacacccacaaaacccacaccacacaacagaggggggggcacagaaaattgccgcagggcgcagatctcgtgcccgttttttggcaccgggcccaaaggagccatcaaccaagcgccgcgcggtaaaccacccggacggcaaccgcgcgggttcgcggaagcacctcgcggtgacatcggcccacacgagacagccgagaaaatcacgtgaggtcccctctcgggatcgcgttataaccgaacacgccagggggagcagacacaccatcacagcagcac

SEQ ID NO: 359348 - DNA, 2826 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggcaagttcacctcctttcaattccctcctattactgctgttttacccctcacagtaatgatgattcattctcattgtttcttcccagttttggaattcaagaacacctaaggattccactgatttgctgatctgaaactagtactatgctctacatataatggacccttaatgaatattattaatttatttttctttacctatttgctaatcagatacctctgttgtgaagaaagggtaaaaatgtgtgttttttaaaaaaatgttggaaataacattagatttataatgccagctcaaaaacagagctgaccatttctctttcatatgttggctgacaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359349 - DNA, 2959 bp, Homo sapiens
gtgcctggctaagcaggtattcatccagttcttgtgctgcagagaacagctgtaagctttgcccttgtaatagaatcacttttgtctttgagcaaaagcagaaaacttttgtcatctttcctccaactttccttaaatggacactgtttccttaaaaggacaacagtggaaagaactaaagcaaacctcagccagaagacacagggagttgcaggaacctactggctgagacagtagaatgaagaattgatgagctctccttctctgtctgcaggaaaatgctgtccagtggggtgtgtacatcaactgttcagcttcctgggaaagtagttgtggtcacaggagctaatacaggtatcgggaaggagacagccaaagagctggctcagagaggcaagttcacctcctttcaattccctcctattactgctgttttacccctcacagtaatgatgattcattctcattgtttcttcccagttttggaattcaagaacacctaaggattccactgatttgctgatctgaaactagtactatgctctacatataatggacccttaatgaatattattaatttatttttctttacctatttgctaatcagatacctctgttgtgaagaaagggtaaaaatgtgtgttttttaaaaaaatgttggaaataacattagatttataatgccagctcaaaaacagagctgaccatttctctttcatatgttggctgacaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359350 - DNA, 2106 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359351 - DNA, 1864 bp, Homo sapiens
ggaagtcggctaggtacgaggctgggtggttacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359352 - DNA, 2102 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359353 - DNA, 1791 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgacacatgctgcagtatggatggggcttgaggacattatgctaagtgaaataagccagttacaaaaagacaaacactgg

SEQ ID NO: 359354 - DNA, 1480 bp, Homo sapiens
ggaagtcggctaggtacgaggctgggtggttacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359355 - DNA, 608 bp, Homo sapiens
agagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgcacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgatta

SEQ ID NO: 359356 - DNA, 4935 bp, Homo sapiens
tgcatacaccagttctcaggatatcggaatccggtgcacagcagcttcttcaggtttgaggttccggatgcctgggggcggagaaacgggaggggaaaaacagatggcaaggtgaggcgtccatggaacgacttctggcccagctgtgcggcagcagcgcagcgtggccgctcccgctgtgggagggggacaccacaggccactgcttcacccagctggtgctcagcgccctgccccacgcgctcctcgccgtgctcagtgcctgttacttgggcaccccgaggagtccagattacatcctaccctgcagtcctggatggcgcctccgacttgcagcttccttcctgctttccgtcttcccgctgctagaccttcttccagttgctttgccaccaggggcaggcccaggacccatagggctagaggtgttggcagggtgcgtggcagctgtggcctggatcagccacagcctggccctgtgggtgttggcacattcccctcatggccactcccggggtcccttggccttggccctggtagccttgctgccagctccagccctagtgctgaccgtgttgtggcattgccagcgaggcacacttctgcccccacttctcccagggcccatggcccgcctatgcttgctcatcctgcagctggctgcactcttggcctatgcactgggatgggcagctcctgggggaccacgagaaccctgggctcaggagcccctcctgcccgaggatcaagaacctgaggtggctgaagatggggagagttggctgtcacgcttttcctatgcctggctggcacccttgctggcccgtggggcctgtggagagctccggcagcctcaggacatttgccgcctcccccacagactgcagccaacctacctggctcgtgtcttccaggcacactggcaggagggggcacggctgtggagggccttgtatggggcctttggacggtgctatctggcacttggactgctgaagctggtggggaccatgttgggattctcagggcccctgttgctctccctactggtgggcttcctggaagaggggcaggagccactaagccacggcctgctctatgctctggggctagccggtggggctgtgctgggtgctgtgctgcagaatcagtatgggtatgaggtatataaggtaacacttcaggcacggggggctgtgctgaacatcctgtactgcaaggctttacagctggggcccagccgccctcctactggggaggccctgaacctactaggcactgactctgaacggctgcttaactttgctgggagcttccatgaagcctggggcctgcccctgcaactggccatcaccctctacctgctgtaccagcaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggagaagggtgtcacccttagcggaggacagcgtgcccggattgcccttgctcgtgctgtctaccaggaaaaggagctctatctcctcgatgaccctctggccgctgtggatgcagatgtggccaaccacctgctgcacaggtgcatcctgggcatgctgagctacaccacacggctgctctgcacccaccgcactgagtacctggagagggctgacgcggtgctgctgatggaggccgggcgcctcatccgggctggacctccctctgagattctgccactggtacaagctgtccccaaagcctgggctgagaatggacaagagtctgactcagccacagcccagtcagtacagaacccagagaaaacaaaggaggggctggaggaggagcagagcacatctggtcgcctgctgcaggaagaaagcaagaaggagggcgccgtggccttgcacgtgtaccaagcttactggaaggccgtgggccagggcttggccttagccatcctcttctctctgcttctcatgcaagccacgcggaacgctgctgactggtggctctcccactggatctctcagctgaaggctgagaatagctcccaggaggcgcaaccctccaccagcccagcttctatggggctcttctctccgcagctgctcctcttttcccctggaaacctctacatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatggcaccagtgactttcttcaatgccacacccacgggccggatcctaaaccgcttctcctctgatgtggcctgtgcggatgacagcctgcccttcatcctcaacatcctcctggccaacgcggcaggcctgctggggctcctggccgtgctgggctctggcctgccctggctgctgctcctgctgccgcctttgagcatcatgtactatcacgtgcagcgccactacagggcctcctcacgggagctgcggcgcctgggcagcctcaccctgtctccactgtatagccatctggccgataccttggctggcctctctgtgctccgggccacaggggccacctacaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcagctgggcaccggctggctgacccagggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctcttccggctgctagagcccagttcagggcgagtgctgctggacggcgtggacaccagccagctggagctggcccagctcagatcccagttggctatcatcccccaggagccctttttgttcagtgggactgttcgggaaaacctggacccccagggcctacataaggacagggccttgtggcaggccctgaagcagtgccacctgagtgaggtgattacatccatgggtggtctggatggtgagctgggtgaggggggccggagcttatctcttgggcagaggcagctgttgtgtttggccagggctctcctcacagatgccaagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctctctgatccaggccgggcctatacagaggtgctggctgcttgtttacattctcctctggggctctacctctccacacttccccagaagggaaaagggcaccctggattactctttggaaatcactccttggtgggcagcatcctgaggcttccccagaaccaggcctctgctctggccctcttgcatctggaacgccaggtgggtttttctggcataggagcccacttgcattttcatagttttatttgataaaattccatcttacattctgtgtattaaaaaaataatatttctggtgtg

SEQ ID NO: 359357 - DNA, 547 bp, Homo sapiens
cgacagccccctcctcaccacccagcatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatgggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcaggtgggcctgtacccccaccccaggccaaagctctggaaccctgaaggccccagtctccctcacaattcctttctttttgcccacccatctttctcagctcccataacctctcttcatgatgaccacaattcttcaccatgtcccttcttccccatctctcattctctcatt

SEQ ID NO: 359358 - DNA, 2751 bp, Homo sapiens
  misc_feature (19)..(19): n is a, c, g, or t
ggtggtagtctagagatcncgaagtcaccgcgtagtaatgagaagtaaccctggacagagtggcaggcatagctctggcggtcctcttggggatggacattcgtccctctctgctggtcggaatcaaggtttacaaggatggacttgagtcctgctcgaggtctaggggtatccagagcagggtgggttagagagggaggcctaagagtcctgctcgaggtctaggggtatcctgctagggtgggttagacggggaggcctgagaggatgagaggtgggatctgcacacgcactgagaaaggcatagtatagactcagaacagtcctctcccaatctccccttctaccctccaggacctccctctgagattctgccactggtacaagctgtccccaaagcctgggctgagaatggacaagagtctgactcagccacagcccagtcagtacagaacccagagaaaacaaaggaggggctggaggaggagcagagcacatctggtcgcctgctgcaggaagaaagcaagaaggagggcgccgtggccttgcacgtgtaccaagcttactggaaggccgtgggccagggcttggccttagccatcctcttctctctgcttctcatgcaagccacgcggaacgctgctgactggtggctctcccactggatctctcagctgaaggctgagaatagctcccaggaggcgcaaccctccaccagcccagcttctatggggctcttctctccgcagctgctcctcttttcccctggaaacctctacatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatggcaccagtgactttcttcaatgccacacccacgggccggatcctaaaccgcttctcctctgatgtggcctgtgcggatgacagcctgcccttcatcctcaacatcctcctggccaacgcggcaggcctgctggggctcctggccgtgctgggctctggcctgccctggctgctgctcctgctgccgcctttgagcatcatgtactatcacgtgcagcgccactacagggcctcctcacgggagctgcggcgcctgggcagcctcaccctgtctccactgtatagccatctggccgataccttggctggcctctctgtgctccgggccacaggggccacctacaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcagctgggcaccggctggctgacccagggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctcttccggctgctagagcccagttcagggcgagtgctgctggacggcgtggacaccagccagctggagctggcccagctcagatcccagttggctatcatcccccaggagccctttttgttcagtgggactgttcgggaaaacctggacccccagggcctacataaggacagggccttgtggcaggccctgaagcagtgccacctgagtgaggtgattacatccatgggtggtctggatggtgagctgggtgaggggggccggagcttatctcttgggcagaggcagctgttgtgtttggccagggctctcctcacagatgccaagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctctctgatccaggccgggcctatacagaggtgctggctgcttgtttacattctcctctggggctctacctctccacacttccccagaagggaaaagggcaccctggattactctttggaaatcactccttggtgggcagcatcctgaggcttccccagaaccaggcctctgctctggccctcttgcatctggaacgccaggtgggtttttctggcataggagcccacttgcattttcatagttttatttgataaaattccatcttacattctgtgtattaaaaaaataatatttctggtgtg

SEQ ID NO: 359359 - DNA, 5376 bp, Homo sapiens
tgcatacaccagttctcaggatatcggaatccggtgcacagcagcttcttcaggtttgaggttccggatgcctgggggcggagaaacgggaggggaaaaacagatggcaaggtgaggcgtccatggaacgacttctggcccagctgtgcggcagcagcgcagcgtggccgctcccgctgtgggagggggacaccacaggccactgcttcacccagctggtgctcagcgccctgccccacgcgctcctcgccgtgctcagtgcctgttacttgggcaccccgaggagtccagattacatcctaccctgcagtcctggatggcgcctccgacttgcagcttccttcctgctttccgtcttcccgctgctagaccttcttccagttgctttgccaccaggggcaggcccaggacccatagggctagaggtgttggcagggtgcgtggcagctgtggcctggatcagccacagcctggccctgtgggtgttggcacattcccctcatggccactcccggggtcccttggccttggccctggtagccttgctgccagctccagccctagtgctgaccgtgttgtggcattgccagcgaggcacacttctgcccccacttctcccagggcccatggcccgcctatgcttgctcatcctgcagctggctgcactcttggcctatgcactgggatgggcagctcctgggggaccacgagaaccctgggctcaggagcccctcctgcccgaggatcaagaacctgaggtggctgaagatggggagagttggctgtcacgcttttcctatgcctggctggcacccttgctggcccgtggggcctgtggagagctccggcagcctcaggacatttgccgcctcccccacagactgcagccaacctacctggctcgtgtcttccaggcacactggcaggagggggcacggctgtggagggccttgtatggggcctttggacggtgctatctggcacttggactgctgaagctggtggggaccatgttgggattctcagggcccctgttgctctccctactggtgggcttcctggaagaggggcaggagccactaagccacggcctgctctatgctctggggctagccggtggggctgtgctgggtgctgtgctgcagaatcagtatgggtatgaggtatataaggtaacacttcaggcacggggggctgtgctgaacatcctgtactgcaaggctttacagctggggcccagccgccctcctactggggaggccctgaacctactaggcactgactctgaacggctgcttaactttgctgggagcttccatgaagcctggggcctgcccctgcaactggccatcaccctctacctgctgtaccagcaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggtaaccaacctcctatgcacccctgtccttactttgtcctttagcaaacactgagcccctcttatgtgttggacaccttttgggggtcaggggtactaagaagagcaacgcatggtccctttattgggagagttttcaatctggaaagaaggaggtggccaagaaagcgaatcattgtaatcattacaccagagtgttttaaatgctataatagtcagcaaaggaatggaaacatccagtgtcagctattctttcagaaatgtggctgtgcagagaagggatccagagaggagcataggtttgagggaggaccttgttttcagatgggaacaagtacaatgtggtggccatactctccactgagctcctgaacagatgtaagtacaacagctgcttggctgtagccaaagagctatttcttcccttcttcgcccagaatgggcttcattaggaccccttgacctcaggagctgccatctcagtcatgtgacatgaagggggaccctgtgtagaagacagcagcctggggaggcttctaggagtcaagggctgggcatggagggacccagaggagagctggtcctcatattgctcgcctggctctctgcaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggagaagggtgtcacccttagcggaggacagcgtgcccggattgcccttgctcgtgctgtctaccaggaaaaggagctctatctcctcgatgaccctctggccgctgtggatgcagatgtggccaaccacctgctgcacaggtgcatcctgggcatgctgagctacaccacacggctgctctgcacccaccgcactgagtacctggagagggctgacgcggtgctgctgatggaggccgggcgcctcatccgggctggacctccctctgagattctgccactggtacaagctgtccccaaagcctgggctgagaatggacaagagtctgactcagccacagcccagtcagtacagaacccagagaaaacaaaggaggggctggaggaggagcagagcacatctggtcgcctgctgcaggaagaaagcaagaaggagggcgccgtggccttgcacgtgtaccaagcttactggaaggccgtgggccagggcttggccttagccatcctcttctctctgcttctcatgcaagccacgcggaacgctgctgactggtggctctcccactggatctctcagctgaaggctgagaatagctcccaggaggcgcaaccctccaccagcccagcttctatggggctcttctctccgcagctgctcctcttttcccctggaaacctctacatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatggcaccagtgactttcttcaatgccacacccacgggccggatcctaaaccgcttctcctctgatgtggcctgtgcggatgacagcctgcccttcatcctcaacatcctcctggccaacgcggcaggcctgctggggctcctggccgtgctgggctctggcctgccctggctgctgctcctgctgccgcctttgagcatcatgtactatcacgtgcagcgccactacagggcctcctcacgggagctgcggcgcctgggcagcctcaccctgtctccactgtatagccatctggccgataccttggctggcctctctgtgctccgggccacaggggccacctacaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcagctgggcaccggctggctgacccagggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctcttccggctgctagagcccagttcagggcgagtgctgctggacggcgtggacaccagccagctggagctggcccagctcagatcccagttggctatcatcccccaggagccctttttgttcagtgggactgttcgggaaaacctggacccccagggcctacataaggacagggccttgtggcaggccctgaagcagtgccacctgagtgaggtgattacatccatgggtggtctggatggtgagctgggtgaggggggccggagcttatctcttgggcagaggcagctgttgtgtttggccagggctctcctcacagatgccaagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctgctctggccctcttgcatctggaacgccaggtgggtttttctggcataggagcccacttgcattttcatagttttatttgataaaattccatcttacattctgtgtattaaaaaaataatatttctggtgtg

SEQ ID NO: 359360 - DNA, 4556 bp, Homo sapiens
tgcatacaccagttctcaggatatcggaatccggtgcacagcagcttcttcaggtttgaggttccggatgcctgggggcggagaaacgggaggggaaaaacagatggcaaggtgaggcgtccatggaacgacttctggcccagctgtgcggcagcagcgcagcgtggccgctcccgctgtgggagggggacaccacaggccactgcttcacccagctggtgctcagcgccctgccccacgcgctcctcgccgtgctcagtgcctgttacttgggcaccccgaggagtccagattacatcctaccctgcagtcctggatggcgcctccgacttgcagcttccttcctgctttccgtcttcccgctgctagaccttcttccagttgctttgccaccaggggcaggcccaggacccatagggctagaggtgttggcagggtgcgtggcagctgtggcctggatcagccacagcctggccctgtgggtgttggcacattcccctcatggccactcccggggtcccttggccttggccctggtagccttgctgccagctccagccctagtgctgaccgtgttgtggcattgccagcgaggcacacttctgcccccacttctcccagggcccatggcccgcctatgcttgctcatcctgcagctggctgcactcttggcctatgcactgggatgggcagctcctgggggaccacgagaaccctgggctcaggagcccctcctgcccgaggatcaagaacctgaggtggctgaagatggggagagttggctgtcacgcttttcctatgcctggctggcacccttgctggcccgtggggcctgtggagagctccggcagcctcaggacatttgccgcctcccccacagactgcagccaacctacctggctcgtgtcttccaggcacactggcaggagggggcacggctgtggagggccttgtatggggcctttggacggtgctatctggcacttggactgctgaagctggtggggaccatgttgggattctcagggcccctgttgctctccctactggtgggcttcctggaagaggggcaggagccactaagccacggcctgctctatgctctggggctagccggtggggctgtgctgggtgctgtgctgcagaatcagtatgggtatgaggtatataaggtaacacttcaggcacggggggctgtgctgaacatcctgtactgcaaggctttacagctggggcccagccgccctcctactggggaggccctgaacctactaggcactgactctgaacggctgcttaactttgctgggagcttccatgaagcctggggcctgcccctgcaactggccatcaccctctacctgctgtaccagcaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggtaaccaacctcctatgcacccctgtccttactttgtcctttagcaaacactgagcccctcttatgtgttggacaccttttgggggtcaggggtactaagaagagcaacgcatggtccctttattgggagagttttcaatctggaaagaaggaggtggccaagaaagcgaatcattgtaatcattacaccagagtgttttaaatgctataatagtcagcaaaggaatggaaacatccagtgtcagctattctttcagaaatgtggctgtgcagagaagggatccagagaggagcataggtttgagggaggaccttgttttcagatgggaacaagtacaatgtggtggccatactctccactgagctcctgaacagatgtaagtacaacagctgcttggctgtagccaaagagctatttcttcccttcttcgcccagaatgggcttcattaggaccccttgacctcaggagctgccatctcagtcatgtgacatgaagggggaccctgtgtagaagacagcagcctggggaggcttctaggagtcaagggctgggcatggagggacccagaggagagctggtcctcatattgctcgcctggctctctgcaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggagaagggtgtcacccttagcggaggacagcgtgcccggattgcccttgctcgtgctgtctaccaggaaaaggagctctatctcctcgatgaccctctggccgctgtggatgcagatgtggccaaccacctgctgcacaggtgcatcctgggcatgctgagctacaccacacggctgctctgcacccaccgcactgagtacctggagagggctgacgcggtgctgctgatggaggccgggcgcctcatccgggctggacctccctctgagattctgccactggtacaagctgtccccaaagcctgggctgagaatggacaagagtctgactcagccacagcccagtcagtacagaacccagagaaaacaaaggaggggctggaggaggagcagagcacatctggtcgcctgctgcaggaagaaagcaagaaggagggcgccgtggccttgcacgtgtaccaagcttactggaaggccgtgggccagggcttggccttagccatcctcttctctctgcttctcatgcaagccacgcggaacgctgctgactggtggctctcccactggatctctcagctgaaggctgagaatagctcccaggaggcgcaaccctccaccagcccagcttctatggggctcttctctccgcagctgctcctcttttcccctggaaacctctacatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatggcaccagtgactttcttcaatgccacacccacgggccggatcctaaaccgcttctcctctgatgtggcctgtgcggatgacagcctgcccttcatcctcaacatcctcctggccaacgcggcaggcctgctggggctcctggccgtgctgggctctggcctgccctggctgctgctcctgctgccgcctttgagcatcatgtactatcacgtgcagcgccactacagggcctcctcacgggagctgcggcgcctgggcagcctcaccctgtctccactgtatagccatctggccgataccttggctggcctctctgtgctccgggccacaggggccacctacaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccaggtgccacccaggacccctcacccctacctcacccacaagttagtccaccgctctcccagatctctccctgcaccatccccccaacattttcacctcccacccagggttccctgtgaggatgtatcatgattatcatcatcacccccgtttggagttgaggagacaatccccaggagggacttgcccaggtggtggtggcttggggactagaatgagtcttctgagctgctggtctcagtcccttccctgcttccaccccgtccccaccacactgccccag

SEQ ID NO: 359361 - DNA, 468 bp, Homo sapiens
agggatggggaaggaggaaagcaacagaagaaggagatagggaggcagagtggacccccactttgaaagagcacactggcatctgcagccctgagggaggcctgtgggtatacagaccagctcccaagaaggagctgctcaataagggccttccctgttgaggccctgaggctgggtggctcagggcaacagtggagtggcttcacatccctctggccttccctaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccaggtgccacccaggacccctcacccctacctcacccacaagttagtccaccgctctcccagatctctccctgca

SEQ ID NO: 359362 - DNA, 507 bp, Homo sapiens
cctgacctcgtgatccacctgccttggcctcccaaagtgctggaattacaggcgtgagccaccgcgcccagcctctgttgcttcctttaaatgccagcagtccacagcctggggagtctcccacaaacgtcccggtgtccaagctctcccagcagctggtacttctctcccccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcaggtgggcctgtacccccaccccaggccaaagctctggaaccctgaaggccccagtctccctcacaattcctttctttttgcccacccatctttctcagctcccataacctctcttcatgatgaccacaattcttcaccatgtcccttcttccccatctctcattctctcatt

SEQ ID NO: 359363 - DNA, 6318 bp, Homo sapiens
tgcatacaccagttctcaggatatcggaatccggtgcacagcagcttcttcaggtttgaggttccggatgcctgggggcggagaaacgggaggggaaaaacagatggcaaggtgaggcgtccatggaacgacttctggcccagctgtgcggcagcagcgcagcgtggccgctcccgctgtgggagggggacaccacaggccactgcttcacccagctggtgctcagcgccctgccccacgcgctcctcgccgtgctcagtgcctgttacttgggcaccccgaggagtccagattacatcctaccctgcagtcctggatggcgcctccgacttgcagcttccttcctgctttccgtcttcccgctgctagaccttcttccagttgctttgccaccaggggcaggcccaggacccatagggctagaggtgttggcagggtgcgtggcagctgtggcctggatcagccacagcctggccctgtgggtgttggcacattcccctcatggccactcccggggtcccttggccttggccctggtagccttgctgccagctccagccctagtgctgaccgtgttgtggcattgccagcgaggcacacttctgcccccacttctcccagggcccatggcccgcctatgcttgctcatcctgcagctggctgcactcttggcctatgcactgggatgggcagctcctgggggaccacgagaaccctgggctcaggagcccctcctgcccgaggatcaagaacctgaggtggctgaagatggggagagttggctgtcacgcttttcctatgcctggctggcacccttgctggcccgtggggcctgtggagagctccggcagcctcaggacatttgccgcctcccccacagactgcagccaacctacctggctcgtgtcttccaggcacactggcaggagggggcacggctgtggagggccttgtatggggcctttggacggtgctatctggcacttggactgctgaagctggtggggaccatgttgggattctcagggcccctgttgctctccctactggtgggcttcctggaagaggggcaggagccactaagccacggcctgctctatgctctggggctagccggtggggctgtgctgggtgctgtgctgcagaatcagtatgggtatgaggtatataaggtaacacttcaggcacggggggctgtgctgaacatcctgtactgcaaggctttacagctggggcccagccgccctcctactggggaggccctgaacctactaggcactgactctgaacggctgcttaactttgctgggagcttccatgaagcctggggcctgcccctgcaactggccatcaccctctacctgctgtaccagcaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggtaaccaacctcctatgcacccctgtccttactttgtcctttagcaaacactgagcccctcttatgtgttggacaccttttgggggtcaggggtactaagaagagcaacgcatggtccctttattgggagagttttcaatctggaaagaaggaggtggccaagaaagcgaatcattgtaatcattacaccagagtgttttaaatgctataatagtcagcaaaggaatggaaacatccagtgtcagctattctttcagaaatgtggctgtgcagagaagggatccagagaggagcataggtttgagggaggaccttgttttcagatgggaacaagtacaatgtggtggccatactctccactgagctcctgaacagatgtaagtacaacagctgcttggctgtagccaaagagctatttcttcccttcttcgcccagaatgggcttcattaggaccccttgacctcaggagctgccatctcagtcatgtgacatgaagggggaccctgtgtagaagacagcagcctggggaggcttctaggagtcaagggctgggcatggagggacccagaggagagctggtcctcatattgctcgcctggctctctgcaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggagaagggtgtcacccttagcggaggacagcgtgcccggattgcccttgctcgtgctgtctaccaggaaaaggagctctatctcctcgatgaccctctggccgctgtggatgcagatgtggccaaccacctgctgcacaggtgcatcctgggcatgctgagctacaccacacggctgctctgcacccaccgcactgagtacctggagagggctgacgcggtgctgctgatggaggccgggcgcctcatccgggctggtaatgggggcaggagccccgtgtgagggaggtgtctgcccaggtctggcaggggattgtgaagtacagactctgccccctgctgcatgtgtgccctgagccagtcattgctgcctcccgccttcacagaactggtgtgaggaactgggagaacaggagggaaaaggagtacgttggtaaaatgccagtgtatttgggactcatgggctttgtgactgggtgctcttgggaacttaaaggcccagggtctctgagaacattctcatatcttcagagaagagaaaggagtcaggtttagaatggtctttttgtaaaaacaaaaatttttaaactctgaaagatttttatgcagagggatgtgaccacctgcaagtttactgggagagaaataggaggaaatgaagctccagccagatattaggaattgagcgaagcatgagaaaaagctctgcagtaatgagaagtaaccctggacagagtggcaggcatagctctggcggtcctcttggggatggacattcgtccctctctgctggtcggaatcaaggtttacaaggatggacttgagtcctgctcgaggtctaggggtatccagagcagggtgggttagagagggaggcctaagagtcctgctcgaggtctaggggtatcctgctagggtgggttagacggggaggcctgagaggatgagaggtgggatctgcacacgcactgagaaaggcatagtatagactcagaacagtcctctcccaatctccccttctaccctccaggacctccctctgagattctgccactggtacaagctgtccccaaagcctgggctgagaatggacaagagtctgactcagccacagcccagtcagtacagaacccagagaaaacaaaggaggggctggaggaggagcagagcacatctggtcgcctgctgcaggaagaaagcaagaaggagggcgccgtggccttgcacgtgtaccaagcttactggaaggccgtgggccagggcttggccttagccatcctcttctctctgcttctcatgcaagccacgcggaacgctgctgactggtggctctcccactggatctctcagctgaaggctgagaatagctcccaggaggcgcaaccctccaccagcccagcttctatggggctcttctctccgcagctgctcctcttttcccctggaaacctctacatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatggcaccagtgactttcttcaatgccacacccacgggccggatcctaaaccgcttctcctctgatgtggcctgtgcggatgacagcctgcccttcatcctcaacatcctcctggccaacgcggcaggcctgctggggctcctggccgtgctgggctctggcctgccctggctgctgctcctgctgccgcctttgagcatcatgtactatcacgtgcagcgccactacagggcctcctcacgggagctgcggcgcctgggcagcctcaccctgtctccactgtatagccatctggccgataccttggctggcctctctgtgctccgggccacaggggccacctacaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcagctgggcaccggctggctgacccagggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctcttccggctgctagagcccagttcagggcgagtgctgctggacggcgtggacaccagccagctggagctggcccagctcagatcccagttggctatcatcccccaggagccctttttgttcagtgggactgttcgggaaaacctggacccccagggcctacataaggacagggccttgtggcaggccctgaagcagtgccacctgagtgaggtgattacatccatgggtggtctggatggtgagctgggtgaggggggccggagcttatctcttgggcagaggcagctgttgtgtttggccagggctctcctcacagatgccaagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctctctgatccaggccgggcctatacagaggtgctggctgcttgtttacattctcctctggggctctacctctccacacttccccagaagggaaaagggcaccctggattactctttggaaatcactccttggtgggcagcatcctgaggcttccccagaaccaggcctctgctctggccctcttgcatctggaacgccaggtgggtttttctggcataggagcccacttgcattttcatagttttatttgataaaattccatcttacattctgtgtattaaaaaaataatatttctggtgtg

SEQ ID NO: 359364 - DNA, 5645 bp, Homo sapiens
  misc_feature (5410)..(5411): n is a, c, g, or t
tgcatacaccagttctcaggatatcggaatccggtgcacagcagcttcttcaggtttgaggttccggatgcctgggggcggagaaacgggaggggaaaaacagatggcaaggtgaggcgtccatggaacgacttctggcccagctgtgcggcagcagcgcagcgtggccgctcccgctgtgggagggggacaccacaggccactgcttcacccagctggtgctcagcgccctgccccacgcgctcctcgccgtgctcagtgcctgttacttgggcaccccgaggagtccagattacatcctaccctgcagtcctggatggcgcctccgacttgcagcttccttcctgctttccgtcttcccgctgctagaccttcttccagttgctttgccaccaggggcaggcccaggacccatagggctagaggtgttggcagggtgcgtggcagctgtggcctggatcagccacagcctggccctgtgggtgttggcacattcccctcatggccactcccggggtcccttggccttggccctggtagccttgctgccagctccagccctagtgctgaccgtgttgtggcattgccagcgaggcacacttctgcccccacttctcccagggcccatggcccgcctatgcttgctcatcctgcagctggctgcactcttggcctatgcactgggatgggcagctcctgggggaccacgagaaccctgggctcaggagcccctcctgcccgaggatcaagaacctgaggtggctgaagatggggagagttggctgtcacgcttttcctatgcctggctggcacccttgctggcccgtggggcctgtggagagctccggcagcctcaggacatttgccgcctcccccacagactgcagccaacctacctggctcgtgtcttccaggcacactggcaggagggggcacggctgtggagggccttgtatggggcctttggacggtgctatctggcacttggactgctgaagctggtggggaccatgttgggattctcagggcccctgttgctctccctactggtgggcttcctggaagaggggcaggagccactaagccacggcctgctctatgctctggggctagccggtggggctgtgctgggtgctgtgctgcagaatcagtatgggtatgaggtatataaggtaacacttcaggcacggggggctgtgctgaacatcctgtactgcaaggctttacagctggggcccagccgccctcctactggggaggccctgaacctactaggcactgactctgaacggctgcttaactttgctgggagcttccatgaagcctggggcctgcccctgcaactggccatcaccctctacctgctgtaccagcaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggtaaccaacctcctatgcacccctgtccttactttgtcctttagcaaacactgagcccctcttatgtgttggacaccttttgggggtcaggggtactaagaagagcaacgcatggtccctttattgggagagttttcaatctggaaagaaggaggtggccaagaaagcgaatcattgtaatcattacaccagagtgttttaaatgctataatagtcagcaaaggaatggaaacatccagtgtcagctattctttcagaaatgtggctgtgcagagaagggatccagagaggagcataggtttgagggaggaccttgttttcagatgggaacaagtacaatgtggtggccatactctccactgagctcctgaacagatgtaagtacaacagctgcttggctgtagccaaagagctatttcttcccttcttcgcccagaatgggcttcattaggaccccttgacctcaggagctgccatctcagtcatgtgacatgaagggggaccctgtgtagaagacagcagcctggggaggcttctaggagtcaagggctgggcatggagggacccagaggagagctggtcctcatattgctcgcctggctctctgcaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggagaagggtgtcacccttagcggaggacagcgtgcccggattgcccttgctcgtgctgtctaccaggaaaaggagctctatctcctcgatgaccctctggccgctgtggatgcagatgtggccaaccacctgctgcacaggtgcatcctgggcatgctgagctacaccacacggctgctctgcacccaccgcactgagtacctggagagggctgacgcggtgctgctgatggaggccgggcgcctcatccgggctggacctccctctgagattctgccactggtacaagctgtccccaaagcctgggctgagaatggacaagagtctgactcagccacagcccagtcagtacagaacccagagaaaacaaaggaggggctggaggaggagcagagcacatctggtcgcctgctgcaggaagaaagcaagaaggagggcgccgtggccttgcacgtgtaccaagcttactggaaggccgtgggccagggcttggccttagccatcctcttctctctgcttctcatgcaagccacgcggaacgctgctgactggtggctctcccactggatctctcagctgaaggctgagaatagctcccaggaggcgcaaccctccaccagcccagcttctatggggctcttctctccgcagctgctcctcttttcccctggaaacctctacatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatggcaccagtgactttcttcaatgccacacccacgggccggatcctaaaccgcttctcctctgatgtggcctgtgcggatgacagcctgcccttcatcctcaacatcctcctggccaacgcggcaggcctgctggggctcctggccgtgctgggctctggcctgccctggctgctgctcctgctgccgcctttgagcatcatgtactatcacgtgcagcgccactacagggcctcctcacgggagctgcggcgcctgggcagcctcaccctgtctccactgtatagccatctggccgataccttggctggcctctctgtgctccgggccacaggggccacctacaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcagctgggcaccggctggctgacccagggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctcttccggctgctagagcccagttcagggcgagtgctgctggacggcgtggacaccagccagctggagctggcccagctcagatcccagttggctatcatcccccaggagccctttttgttcagtgggactgttcgggaaaacctggacccccagggcctacataaggacagggccttgtggcaggccctgaagcagtgccacctgagtgaggtgattacatccatgggtggtctggatggtgagctgggtgaggggggccggagcttatctcttgggcagaggcagctgttgtgtttggccagggctctcctcacagatgccaagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctctctgatccaggccgggcctatacagaggtgctggctgcttgtttacattctcctctggggctctacctctccacacttccccagaagggaaaagggcaccctggattactctttggaaatcactccttggtgggcagcatcctgaggcttccccagaaccaggcnnggtcccccgacagcgcataggcgcctgtaaccctggtccacccaactccagaggaagaccgatacctgatacactctgtgcagcacgagctcccgacactctgctctggccctcttgcatctggaacgccaggtgggtttttctggcataggagcccacttgcattttcatagttttatttgataaaattccatcttacattctgtgtattaaaaaaataatatttctggtgtg

SEQ ID NO: 359365 - DNA, 3059 bp, Homo sapiens
tgcatacaccagttctcaggatatcggaatccggtgcacagcagcttcttcaggtttgaggttccggatgcctgggggcggagaaacgggaggggaaaaacagatggcaaggtgaggcgtccatggaacgacttctggcccagctgtgcggcagcagcgcagcgtggccgctcccgctgtgggagggggacaccacaggccactgcttcacccagctggtgctcagcgccctgccccacgcgctcctcgccgtgctcagtgcctgttacttgggcaccccgaggagtccagattacatcctaccctgcagtcctggatggcgcctccgacttgcagcttccttcctgctttccgtcttcccgctgctagaccttcttccagttgctttgccaccaggggcaggcccaggacccatagggctagaggtgttggcagggtgcgtggcagctgtggcctggatcagccacagcctggccctgtgggtgttggcacattcccctcatggccactcccggggtcccttggccttggccctggtagccttgctgccagctccagccctagtgctgaccgtgttgtggcattgccagcgaggcacacttctgcccccacttctcccagggcccatggcccgcctatgcttgctcatcctgcagctggctgcactcttggcctatgcactgggatgggcagctcctgggggaccacgagaaccctgggctcaggagcccctcctgcccgaggatcaagaacctgaggtggctgaagatggggagagttggctgtcacgcttttcctatgcctggctggcacccttgctggcccgtggggcctgtggagagctccggcagcctcaggacatttgccgcctcccccacagactgcagccaacctacctggctcgtgtcttccaggcacactggcaggagggggcacggctgtggagggccttgtatggggcctttggacggtgctatctggcacttggactgctgaagctggtggggaccatgttgggattctcagggcccctgttgctctccctactggtgggcttcctggaagaggggcaggagccactaagccacggcctgctctatgctctggggctagccggtggggctgtgctgggtgctgtgctgcagaatcagtatgggtatgaggtatataaggtaacacttcaggcacggggggctgtgctgaacatcctgtactgcaaggctttacagctggggcccagccgccctcctactggggaggccctgaacctactaggcactgactctgaacggctgcttaactttgctgggagcttccatgaagcctggggcctgcccctgcaactggccatcaccctctacctgctgtaccagcaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggtaaccaacctcctatgcacccctgtccttactttgtcctttagcaaacactgagcccctcttatgtgttggacaccttttgggggtcaggggtactaagaagagcaacgcatggtccctttattgggagagttttcaatctggaaagaaggaggtggccaagaaagcgaatcattgtaatcattacaccagagtgttttaaatgctataatagtcagcaaaggaatggaaacatccagtgtcagctattctttcagaaatgtggctgtgcagagaagggatccagagaggagcataggtttgagggaggaccttgttttcagatgggaacaagtacaatgtggtggccatactctccactgagctcctgaacagatgtaagtacaacagctgcttggctgtagccaaagagctatttcttcccttcttcgcccagaatgggcttcattaggaccccttgacctcaggagctgccatctcagtcatgtgacatgaagggggaccctgtgtagaagacagcagcctggggaggcttctaggagtcaagggctgggcatggagggacccagaggagagctggtcctcatattgctcgcctggctctctgcaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggagaagggtgtcacccttagcggaggacagcgtgcccggattgcccttgctcgtgctgtctaccaggtcagttaaagatggaggttgcagtggcagggaggtggggggagtccagagccttgggaacttggctgagttaggaggataggaatattttccttagcatc

SEQ ID NO: 359366 - DNA, 578 bp, Homo sapiens
tgcatacaccagttctcaggatatcggaatccggtgcacagcagcttcttcaggtttgaggttccggatgcctgggggcggagaaacgggaggggaaaaacagatggcaaggtgggtgaccagcgtccagaaatccactggggaaacctcctcccgtttttacccttggtaccgcgagaatgggcggggtctggcttcggggcggaagcgacgggcggtcccggttccagggcggggctggagacagggagacccggctgggaagtgcaggcaaagccggctgttaccctgcacagccgtcaccctcaactttcccttcaggtgaggcgtccatggaacgacttctggcccagctgtgcggcagcagcgcagcgtggccgctcccgctgtgggagggggacaccacaggccactgcttcacccagctggtgctcagcgccctgccccacgcgctcctcgccgtgctcagtgcctgttacttgggcaccccgaggtgggtagagacgggcgcaaggcatctgtccatgtgtgcctgcagatctcacccgcggcctacatcttccggcagtgtcaccaga

SEQ ID NO: 359367 - DNA, 541 bp, Homo sapiens
tgtatttttaacattttatggtgacacattgggagttatttccctaagtgagacccttttctgaatatatctgtgccctcatagcctagcagagtattcagacttttgaatgatggaaacaaagctgtgggaaaagagcagaatacaaaataacaataccaatttgagctagcagacattgctgtcaggggtcgggctagaaagatgagaaaaactgaagcctgcttagagaggtgttgacaaccaccagatccagaagaatgacctagataacagggcttcaagttctgacatgattttattagagatgtttcagaaatctctactggagaagttgtgggaacacaggggaataaagtcacggggatgggggaggagtcatgatggtaagtgttgatttccccagcatggatcacctgatagcatcatcagttaaattaggataatagcgatttgagcatacttaagttagtagatgcaagaatgggaggagagggcagaaatacacatggaagcaaaatagagcagaaatatatgggag

SEQ ID NO: 359368 - DNA, 491 bp, Homo sapiens
tgtatttttaacattttatggtgacacattgggagttatttccctaagtgagacccttttctgaatatatctgtgccctcatagcctagcagagtattcagacttttgaatgatggaaacaaagctgtgggaaaagagcagaatacaaaataacaataccaatttgagctagcagacattgctgtcaggggtcgggctagaaagatgagaaaaactgaagcctgcttagagaggtgttgacaaccaccagatccagaagaatgacctagataacagggcttcaagttctgacatgattttattagagatgtttcagaaatctctactggagaagttgtgggaacacaggggaataaagtcacggggatgggggaggagtcatgatggtaagtgttgatttccccagcatggatcacctgatagcatctactaacttaagtatgctcaaatcgctattatcctaatttaactgtcgacgggccgcgaattta

SEQ ID NO: 359369 - DNA, 382 bp, Homo sapiens
acaaaaaacaagcagcgggtgtgtctgggggatgggccagcctctagcctgcagtcgctcccttcccaggcaaaagagagagaactcggtcccctctccctgtaccccacaagagcctgggcaccctccccactcccaccacgaacctgggcttcactgggagggaatttagacacttggatgctggagcctagatctgaggttctgttgagccacggcactgtgacccggactgtcccctccatccccgtccaaactgggagggggcatcccttgtccctggcactcctctgtgatctggcaggtgtgatgagccacagcagggacaggggaataggggctgggctttttagggtgatggcacccagacggtaacaggacg

SEQ ID NO: 359370 - DNA, 896 bp, Homo sapiens
gagtttgagaccagcctgggcagcatagcaaggaccccatctctaccaaaaaaaaacaaaattaatactaccaaggaaatatttaataatatcagttctgcacaaattatgccaggaaataaaagaagatttaacacttcccaactcattttataaaattagtagtattgtgatatcaaaacaagtcaaatagattacaagaaagaaaactacaggcatagacaaaaaaatcttcaagaaaatattggcaaatcaaaacccagcaatattgtaaaaagggataatgcattatgaaagtaggttttatccccaaaaattcaaggttgttttaatcttcagaatgaatcaatgcaattcaccatatcaataaattaaatgaatgggaggctaagacaggcagatcacttcaggttaggagtttgagacagaccagcctggccaaagtggtgaaatcctgtctctactgaaaaaacaaataaaaaaattagccaggtgcggtggcacacacctgtaatcccagctactctggggcatgttgaggcccaagaatctctcgaacccaggaggtggaggttgtgccattgcactccagcctgggcgacagagtgagactctgtctcaaaaaaaaaaaaaaaaaaaaagaaaagaaaagaaaaaagagaaaaaaaaaattaaaaaccccatatgacccatataattactcagtggttagatactgcattaattcataataaataatctcagcaaactaggaattgaaggaatttcctcagcctagtaaagggcaaagataactatcatagagctgatgtaacacttaatggtgaaaaagtgaatgctttcttcctaaaattgagaacaagacaaggtagtcatagcaagttcagttaagcaaa

SEQ ID NO: 359371 - DNA, 357 bp, Homo sapiens
aagtaagctctcagtatttgcaaatgaaatcattttctatgcacaaaatccagcctgggcgacagagtgagactctgtctcaaaaaaaaaaaaaaaaaaaaagaaaagaaaagaaaaaagagaaaaaaaaaattaaaaaccccatatgacccatataattactcagtggttagatactgcattaattcataataaataatctcagcaaactaggaattgaaggaatttcctcagcctagtaaagggcaaagataactatcatagagctgatgtaacacttaatggtgaaaaagtgaatgctttcttcctaaaattgagaacaagacaaggtagtcatagcaagttcagttaagcaaa

SEQ ID NO: 359372 - DNA, 483 bp, Homo sapiens
gtctttgtccttggctggggtagagacagagagaagagacgcaagttggggacctgcaagtagggttccagtccaggtccgcgtgcgcaggccgggcgccctcaggtttagcggccacgcccttgcgttccttccgggttgcgtgaggattcctgaaacgcagttttcagcagctgctctgggcagctccacacgatcctttcagcgaagttgctgccatgtaagaagtccttttcacctcccgccatgattctgagacctccccagccatgtggaactcccgaggtcttggaatcctgaacagtgttccaggtagccaaagctggtctgcagaatgaagctgatgtgcacaaagatattctgccttcaacggaggtgtgaggatcagctccgtctgggtcatgcctggagtccagcttctctcctctcccaaaatgactccgatttggtgctcaaccttgtgatcacagattgccaataaac

SEQ ID NO: 359373 - DNA, 558 bp, Homo sapiens
caggccaacttaatattatgatgattcctcctcgtagggagaagacctgggcaggatgcaggtagggtgactggttgtctgggtttgcctgtgactaagggggtttctaggaacttgggccttgcaaactagaatgaattggtcaccttcaagcggagtctggagaagtcaagacacttggcctgacactctaaaagggtcagcatcttccttgcccacctccaaggagatttaaatactccttcctgcgtgctccagaacactaacttcatacctgtttacattctgccttcttcatttaatccagctgctgggtaaacagccagcatggggccttgcgtgagcacaggccggcaagtgttagatgagcaagtggctgctgaaggcaggtcagacagacccacagtctgtctgtctgtgcacccctctgggcttctatttggcgattatttctgtgtctcttgaaaaaaaaaattctgccccaatgtagcgaaaagtgagcttcttgtagttaaagagcaaaataaggatttaattaaattaaaaaaaaaagaaaag

SEQ ID NO: 359374 - DNA, 1031 bp, Homo sapiens
tgcccacgttgcgccggcctcgcgccagtccgctgggctgcagggactgcggcgcctgagggagtcgctgacgggcacgctgactggaggctggcggacaggcgacagcgacctgcggcagagagtcttgctgcgacacccaggctggagtgcaatggcgctatctcggctcactgcaacctccgcttcccggattcaagcgattctcctgcctcagcctcccgagtaggtgggactacaggcactgagtggtggggtatgccatcctcccctgctggaaccagccttggcctgccctgttagtcatcaaaaatagatctcaccagggaacaatcttctcaggttgttgtgtaatttgagtgagccaagatggagtctcgctctgttgcccaggctggagtgcagtggatcagtctagctcattgcagcctccacctcctgggttcaagagattctcctgcctcagcctcctgtgtagctgggattacaggtgtgcgccaccacgcctggctaataattctatttttagtagagttggggtctcaccatgttggccaggctgctctcgaactcctgacctcaagtgatctgcccgcctcggcctcccaaagagctgggattataggtgtgagtcaccatgcctggcctcttgctcacttttcatactaaaacaacaaattacaggctgtagtttaacctctctactgcatgcataaatgcagtgtggtacgagtgcctctgtagcccataacttcagtttccttgttgctagcagtctgtggtgacactatactaatctcacatgcagcaaccaatgaggattagccagggacacaggaggagtcaccttgcattcagaatgactcaagtttagtctcaacttgaccattagctctctgagtgatcttgcccatgttaattctcttgatcttagtttcttcagagccagtgagacattgcttgaaagtgacttagcctggtatacccaggtctgtcagacttatagtctggtgctctcttgggtgaacttg

SEQ ID NO: 359375 - DNA, 1259 bp, Homo sapiens
tgcccacgttgcgccggcctcgcgccagtccgctgggctgcagggactgcggcgcctgagggagtcgctgacgggcacgctgactggaggctggcggacaggcgacagcgacctgcggcaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctaga

SEQ ID NO: 359376 - DNA, 1288 bp, Homo sapiens
ccgccccaggcacgtgcacagtgagtttgtgtaaatccagttagaccaaaatgagcgaggtggagagcctcttaaccggatgctacgggtgatgactgggaggaggagaaaaattacctctttatcttgcatgaacatcttaattttcaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctaga

SEQ ID NO: 359377 - DNA, 1277 bp, Homo sapiens
gctttattttaaagaaaacaatcctggggtgtgtgggtgtcaccttggttacattcgctctgaggaaagcagaaccgacaggtatttggggaagtgactgccgtgggtgccacatcaccagctccttgtgtctctgcaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctaga

SEQ ID NO: 359378 - DNA, 1132 bp, Homo sapiens
tgcccacgttgcgccggcctcgcgccagtccgctgggctgcagggactgcggcgcctgagggagtcgctgacgggcacgctgactggaggctggcggacaggcgacagcgacctgcggcagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctaga

SEQ ID NO: 359379 - DNA, 833 bp, Homo sapiens
tcttctccgaaaggctacatgaatattgttgtggggaagagactgataataaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctaga

SEQ ID NO: 359380 - DNA, 1160 bp, Homo sapiens
tgcccacgttgcgccggcctcgcgccagtccgctgggctgcagggactgcggcgcctgagggagtcgctgacgggcacgctgactggaggctggcggacaggcgacagcgacctgcggcaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctaga

SEQ ID NO: 359381 - DNA, 931 bp, Homo sapiens
cgagatcaggtcagtaggtaataatgtgttgaactaaccttcttcccattttcaataatgggcagaatgcaagagaacctatgtcaccgagtaacggtgtacacctgtggttctcggggctgccctttggccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagctac

SEQ ID NO: 359382 - DNA, 513 bp, Homo sapiens
tgcccacgttgcgccggcctcgcgccagtccgctgggctgcagggactgcggcgcctgagggagtcgctgacgggcacgctgactggaggctggcggacaggcgacagcgacctgcggcaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaaggtttgtgccccgcattgggttccagactgtcatatggggttggggtgggggccttggtcccatgagaaaagtgcccctggagccactctgagggaaaagctgggcttttctccacactccattccttcttgacgttaagctctggct

SEQ ID NO: 359383 - DNA, 378 bp, Homo sapiens
ccgccccaggcacgtgcacagtgagtttgtgtaaatccagttagaccaaaatgagcgaggtggagagcctcttaaccggatgctacgggtgatgactgggaggaggagaaaaattacctctttatcttgcatgaacatcttaattttcaggaccagaggagcgagagcagcaagaaccacacccagcagcaatgtcagcggaagtggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctaga

SEQ ID NO: 359384 - DNA, 1705 bp, Homo sapiens
tgcccacgttgcgccggcctcgcgccagtccgctgggctgcagggactgcggcgcctgagggagtcgctgacgggcacgctgactggaggctggcggacaggcgacagcgacctgcggcaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagctac

SEQ ID NO: 359385 - DNA, 1319 bp, Homo sapiens
tggcagtacgaggccgggtgttaatcggccgaggggcggacaggcgacagcgacctgcggcagagtcttgctgcgacacccaggctggagtgcaatggcgctatctcggctcactgcaacctccgcttcccggattcaagcgattctcctgcctcagcctcccgagtaggtgggactacaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctaga

SEQ ID NO: 359386 - DNA, 1379 bp, Homo sapiens
tgcccacgttgcgccggcctcgcgccagtccgctgggctgcagggactgcggcgcctgagggagtcgctgacgggcacgctgactggaggctggcggacaggcgacagcgacctgcggcagagagtcttgctgcgacacccaggctggagtgcaatggcgctatctcggctcactgcaacctccgcttcccggattcaagcgattctcctgcctcagcctcccgagtaggtgggactacaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctaga

SEQ ID NO: 359387 - DNA, 1178 bp, Homo sapiens
gcacgagaggggacacgtcgaactgcttggttgtcatcaggagcattatgcagaatgaagcattatagcagcagagactgtctgacagcgcagttggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctaga

SEQ ID NO: 359388 - DNA, 1606 bp, Homo sapiens
tgcccacgttgcgccggcctcgcgccagtccgctgggctgcagggactgcggcgcctgagggagtcgctgacgggcacgctgactggaggctggcggacaggcgacagcgacctgcggcaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagctac

SEQ ID NO: 359389 - DNA, 962 bp, Homo sapiens
tgcccacgttgcgccggcctcgcgccagtccgctgggctgcagggactgcggcgcctgagggagtcgctgacgggcacgctgactggaggctggcggacaggcgacagcgacctgcggcaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctaga

SEQ ID NO: 359390 - DNA, 674 bp, Homo sapiens
tcgagctcggtaccgaagtctgaaggagatccccattccatcggatcctctgttccattgtctgtctgtctcctggacccatcctggcctcgtctttgccctccgtcgcagcctggccttgggcctgcccttcccggggacactcggtctgatccccttccctcctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagctac

SEQ ID NO: 359391 - DNA, 140 bp, Homo sapiens
ggttgaatattggtcaattccagaacagtttcatttttccctacaacgtagggctacttctctgtagcctgcaagggtggcattaacggttattaaagccaggcacagtggctcgcgcctgtaatcccagcactttggga

SEQ ID NO: 359392 - DNA, 815 bp, Homo sapiens
tacttataaattgctattttcttacctcattaatgtttattgagtgcctaccatgctccaggcattattctagcattgggaacacactgacaaacaaggcagacatagtcctgccctcagggatatagaatctagcacaaatgacagtcattttagtaaccataaagagtgtactaacaatggtaataagcatgtattgtaataaatgtcttggaagttttcgtaataaatttgaaaatgtatattctgaaatagaatcaggctaactatagcatgttgaaatgagaatttatagccttagagctgctattagtataaaacaagacttcaggttgttttaatttcattttgcttcaacatttattctgcatcatatactgtggcaagttgctttgaattgttttctgaaaaaaaaaacctttcttctttcatatagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359393 - DNA, 1236 bp, Homo sapiens
aaataagatgcagagcccttctccaaacgatccggctagaaatctaggaagcgctgatccggagcgcacagagacagctgtgttgctcctctatcgcgggggtggtatggccagagtagtgagagaaggtgctctgttacaccagcaggaaataggtgctgtcctgggcctagaactccccgctcgctcctttgctcgcgcacacccggatccttcgtcgcggggaggatgtttccgcccggccgcggtgggcttgacgcaacgtccagcgcgcgcttttcatgccttggcgtttcctttggcggattttctgttttcggaagttgctgggttcgttttattcagcggcagtggtgctttcccgaatctcagaatgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359394 - DNA, 1353 bp, Homo sapiens
aaataagatgcagagcccttctccaaacgatccggctagaaatctaggaagcgctgatccggagcgcacagagacagctgtgttgctcctctatcgcgggggtggtatggccagagtagtgagagaaggtgctctgttacaccagcaggaaataggtgctgtcctgggcctagaactccccgctcgctcctttgctcgcgcacacccggatccttcgtcgcggggaggatgtttccgcccggccgcggtgggcttgacgcaacgtccagcgcgcgcttttcatgccttggcgtttcctttggcggattttctgttttcggaagttgctgggttcgttttattcagcggcagtggtgctttcccgaatctcagaatgccttttgctcccgttgcccaggctggagtgcaatggcacgatttccgttcactgcaacatctgcttcccgcgttcaagcgattctcctgcctcagccttgggagtagttgggattacagtgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359395 - DNA, 1286 bp, Homo sapiens
aaataagatgcagagcccttctccaaacgatccggctagaaatctaggaagcgctgatccggagcgcacagagacagctgtgttgctcctctatcgcgggggtggtatggccagagtagtgagagaaggtgctctgttacaccagcaggaaataggtgctgtcctgggcctagaactccccgctcgctcctttgctcgcgcacacccggatccttcgtcgcggggaggatgtttccgcccggccgcggtgggcttgacgcaacgtccagcgcgcgcttttcatgccttggcgtttcctttggcggattttctgttttcggaagttgctgggttcgttttattcagcggcagtggtgctttcccgaatctcagaatgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaaggtcagcctcagatgtcacaacctctgtgaagctctccccagctctcctagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359396 - DNA, 634 bp, Homo sapiens
caaaaattagctgggtgtggtggcacacacctgtagtcccagctactcaggagactgaggcaggagaatcacttgaacacgggaggcagaggttgcagtcagccgagaccatgccactccactccagcctgggggagagtgagactccgtctcaaaagaaaaaagcaaatgagaggttgccagcagcatctaactaaactaggtaccaaactagattgttattaggtgttaaaatcacttcttaagtcatgtatgacgtgcatgttaactaattcttgataatataattatcttttatatctcacagcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359397 - DNA, 419 bp, Homo sapiens
ctattcttcgtctgtccgtaagagccccacagggcttttgacatgcacgccatcttggactctatgaattccttaaagccattttaaactggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359398 - DNA, 382 bp, Homo sapiens
cttcattaatctagactcattatgcttgcaaccacaaccccacccccgcccttagcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359399 - DNA, 1089 bp, Homo sapiens
aaataagatgcagagcccttctccaaacgatccggctagaaatctaggaagcgctgatccggagcgcacagagacagctgtgttgctcctctatcgcgggggtggtatggccagagtagtgagagaaggtgctctgttacaccagcaggaaataggtgctgtcctgggcctagaactccccgctcgctcctttgctcgcgcacacccggatccttcgtcgcggggaggatgtttccgcccggccgcggtgggcttgacgcaacgtccagcgcgcgcttttcatgccttggcgtttcctttggcggattttctgttttcggaagttgctgggttcgttttattcagcggcagtggtgctttcccgaatctcagaatgcctgttaaaagatcactgaagttggatggtctgttagaagaaaatattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaaggtaagtagttgtgttttagtttattacataaagatgctttcatcccattttgccaattaaaactaatcatcatgaatcctttttagtggttttcttttttcctcagagatccctgttctgaagtatgttcttttagaagatcacaaatctcatttgaaaagctttatattgcatttagcagaagatgatatctgatgagatcaacttctctgatgattgaactttttaaatgtcttttgaaatgcaatcttcaacataagatttgaattttgtctttttattaaaatttctttttgagaatacaaataggagcaacaatgcattaatatactgcagtttttagtgttgcactagaagcattgaaagttactttctaactagtattctggaaactttcagatcattaatatgctttgttctactatgaactcttatgtc

SEQ ID NO: 359400 - DNA, 969 bp, Homo sapiens
tagttttctattttatcttaacattaaacaatatatttttttcaaacagatacttcaattttaaaagcactgaggtttgaagtttagacgtgacgacttttaggagaaacaacagaaattccccctatgctttaacattctgggtttatctggagataaaaaatgaagccattaattttgatagcacaaatatacattaatgtacaactatagtcctcagctctttataatgattcagctatcatgtatgccatatgtgaatcataacctttcctattaataatgttaatgctcttgttttacacgattcgtcattgttttggggtatgcatttcagctgctaaaaatgcttacttgagatttgtctaggatttaagtaaaaataaactgatttattacttttcaaagccttttaaataatttctttcatgatttaaattttttatactttaacagaagtatgataatttttctttcaaataaaatcagtagaaaaaattttaaactatagatttggactcacttaatagcaattaggtgtttaagaggtgtaaataacttgctatcagacattacaaatatccaggtgctcagtatgtgctgatgacaacaaaattgaaaagaaagactgtaataattctgactggttttctctgcagaagatattgattatttgtgtgtggtgagagatttggaaaattcaattaaaggagttgtgcaaaggtttcataaattttccttctacagcgtgtacacagacattgttgcgtattaaatcagtgcagcacttcacaatatattttctttgaaacataaaaataaataacatttaaacagttctgcttactacagaaacaaattttattttctgtgaagcatttagtcatgtgctatcactgactcatacacatttgccagctgtaacaaattttatagacattttccccagagacatatctcacatactat

SEQ ID NO: 359401 - DNA, 1100 bp, Homo sapiens
aaataagatgcagagcccttctccaaacgatccggctagaaatctaggaagcgctgatccggagcgcacagagacagctgtgttgctcctctatcgcgggggtggtatggccagagtagtgagagaaggtgctctgttacaccagcaggaaataggtgctgtcctgggcctagaactccccgctcgctcctttgctcgcgcacacccggatccttcgtcgcggggaggatgtttccgcccggccgcggtgggcttgacgcaacgtccagcgcgcgcttttcatgccttggcgtttcctttggcggattttctgttttcggaagttgctgggttcgttttattcagcggcagtggtgctttcccgaatctcagaatgcctgttaaaagatcactgaagttggatggtctgttagaagaaaataaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359402 - DNA, 1203 bp, Homo sapiens
gcgatgcgagcgatgagctggatggcctccttcatgtagaaccggccgtccccgcccaccaccagcgtggcctcctgccgctgcgccggctccacggtggagatgatactctggatgaagttctccgcgtagttggcgctgctctggaacaccttcacccgcttccgcagcccgctcgtgcccggcttctggtcctgttttattttggatgtcgacaaaagccctgattaccatgctgccctagcaacaacagtgtaagagggttcccttttctccacatccttgccagcatttgaagtccacatgaaagaaaattatatcttctgttcagttttgagaaaaaagtgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359403 - DNA, 1030 bp, Homo sapiens
aaataagatgcagagcccttctccaaacgatccggctagaaatctaggaagcgctgatccggagcgcacagagacagctgtgttgctcctctatcgcgggggtggtatggccagagtagtgagagaaggtgctctgttacaccagcaggaaataggtgctgtcctgggcctagaactccccgctcgctcctttgctcgcgcacacccggatccttcgtcgcggggaggatgtttccgcccggccgcggtgggcttgacgcaacgtccagcgcgcgcttttcatgccttggcgtttcctttggcggattttctgttttcggaagttgctgggttcgttttattcagcggcagtggtgctttcccgaatctcagaatgcctgttaaaagatcactgaagttggatggtctgttagaagaaaatattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359404 - DNA, 646 bp, Homo sapiens
  misc_feature (34)..(35): n is a, c, g, or t
cacataccccttgcgaacatcgacaaccaaaggnngctcgcatgaacagttgcttcatagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359405 - DNA, 1150 bp, Homo sapiens
aaataagatgcagagcccttctccaaacgatccggctagaaatctaggaagcgctgatccggagcgcacagagacagctgtgttgctcctctatcgcgggggtggtatggccagagtagtgagagaaggtgctctgttacaccagcaggaaataggtgctgtcctgggcctagaactccccgctcgctcctttgctcgcgcacacccggatccttcgtcgcggggaggatgtttccgcccggccgcggtgggcttgacgcaacgtccagcgcgcgcttttcatgccttggcgtttcctttggcggattttctgttttcggaagttgctgggttcgttttattcagcggcagtggtgctttcccgaatctcagaatgcctgttaaaagatcactgaagttggatggtctgttagaagaaaataaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaaggtcagcctcagatgtcacaacctctgtgaagctctccccagctctcctagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359406 - DNA, 663 bp, Homo sapiens
  misc_feature (12)..(12): n is a, c, g, or t
aggtcagggganataacagcgcccaccgcccgcccccctgaccccaaccccaccttgagatgtcgagccatatatagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359407 - DNA, 1777 bp, Homo sapiens
aaataagatgcagagcccttctccaaacgatccggctagaaatctaggaagcgctgatccggagcgcacagagacagctgtgttgctcctctatcgcgggggtggtatggccagagtagtgagagaaggtgctctgttacaccagcaggaaataggtgctgtcctgggcctagaactccccgctcgctcctttgctcgcgcacacccggatccttcgtcgcggggaggatgtttccgcccggccgcggtgggcttgacgcaacgtccagcgcgcgcttttcatgccttggcgtttcctttggcggattttctgttttcggaagttgctgggttcgttttattcagcggcagtggtgctttcccgaatctcagaatgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagatacttcaattttaaaagcactgaggtttgaagtttagacgtgacgacttttaggagaaacaacagaaattccccctatgctttaacattctgggtttatctggagataaaaaatgaagccattaattttgatagcacaaatatacattaatgtacaactatagtcctcagctctttataatgattcagctatcatgtatgccatatgtgaatcataacctttcctattaataatgttaatgctcttgttttacacgattcgtcattgttttggggtatgcatttcagctgctaaaaatgcttacttgagatttgtctaggatttaagtaaaaataaactgatttattacttttcaaagccttttaaataatttctttcatgatttaaattttttatactttaacagaagtatgataatttttctttcaaataaaatcagtagaaaaaattttaaactatagatttggactcacttaatagcaattaggtgtttaagaggtgtaaataacttgctatcagacattacaaatatccaggtgctcagtatgtgctgatgacaacaaaattgaaaagaaagactgtaataattctgactggttttctctgcagaagatattgattatttgtgtgtggtgagagatttggaaaattcaattaaaggagttgtgcaaaggtttcataaattttccttctacagcgtgtacacagacattgttgcgtattaaatcagtgcagcacttcacaatatattttctttgaaacataaaaataaataacatttaaacagttctgcttactacagaaacaaattttattttctgtgaagcatttagtcatgtgctatcactgactcatacacatttgccagctgtaacaaattttatagacattttccccagagacatatctcacatactat

SEQ ID NO: 359408 - DNA, 700 bp, Homo sapiens
gcgatgcgagcgatgagctggatggcctccttcatgtagaaccggccgtccccgcccaccaccagcgtggcctcctgccgctgcgccggctccacggtggagatgatactctggatgaagttctccgcgtagttggcgctgctctggaacaccttcacccgcttccgcagcccgctcgtgcccggcttctggtcctgttttattttggatgtcgacaaaagccctgattaccatgctgccctagcaacaacagtgtaagagggttcccttttctccacatccttgccagcatttgaagtccacatgaaagaaaattatatcttctgttcagttttgagaaaaaaggtatgtaactttttctcacaagtggtagcttagcatatgcttgctgctatctttagtaacaaagaaaatattgttttaaaaaatgtactggtaattagacaagaacaactttctcagaataaaattaattatgccaaaacatgtactcagtaagcagatgtccccatagctaagaaattgatacaatctatttcctactaactttaatctctaggtttagaattagctggatctaatgattaagtttgatgatagtaaaaatatcacgtagctgtagatatttaaattttgacaccatgatatggatcttttgccagggtttactttaaagttctgacatgcatctataatcctg

SEQ ID NO: 359409 - DNA, 1193 bp, Homo sapiens
aaataagatgcagagcccttctccaaacgatccggctagaaatctaggaagcgctgatccggagcgcacagagacagctgtgttgctcctctatcgcgggggtggtatggccagagtagtgagagaaggtgctctgttacaccagcaggaaataggtgctgtcctgggcctagaactccccgctcgctcctttgctcgcgcacacccggatccttcgtcgcggggaggatgtttccgcccggccgcggtgggcttgacgcaacgtccagcgcgcgcttttcatgccttggcgtttcctttggcggattttctgttttcggaagttgctgggttcgttttattcagcggcagtggtgctttcccgaatctcagaatgcctcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359410 - DNA, 925 bp, Homo sapiens
aaatggcaggatgcgaaggccgggggcgtttatcagcggcagggtgctttcccggaatctcagaatgcctgttaaagatcactgaagtggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaa

SEQ ID NO: 359411 - DNA, 1235 bp, Homo sapiens
aaataagatgcagagcccttctccaaacgatccggctagaaatctaggaagcgctgatccggagcgcacagagacagctgtgttgctcctctatcgcgggggtggtatggccagagtagtgagagaaggtgctctgttacaccagcaggaaataggtgctgtcctgggcctagaactccccgctcgctcctttgctcgcgcacacccggatccttcgtcgcggggaggatgtttccgcccggccgcggtgggcttgacgcaacgtccagcgcgcgcttttcatgccttggcgtttcctttggcggattttctgttttcggaagttgctgggttcgttttattcagcggcagtggtgctttcccgaatctcagaatgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgacgctgcgtatgtcaggtgtatgcctttgtataaaggcgtctaaatgcacagtgacatctgt

SEQ ID NO: 359412 - DNA, 1593 bp, Homo sapiens
aaataagatgcagagcccttctccaaacgatccggctagaaatctaggaagcgctgatccggagcgcacagagacagctgtgttgctcctctatcgcgggggtggtatggccagagtagtgagagaaggtgctctgttacaccagcaggaaataggtgctgtcctgggcctagaactccccgctcgctcctttgctcgcgcacacccggatccttcgtcgcggggaggatgtttccgcccggccgcggtgggcttgacgcaacgtccagcgcgcgcttttcatgccttggcgtttcctttggcggattttctgttttcggaagttgctgggttcgttttattcagcggcagtggtgctttcccgaatctcagaatgccttttgctcccgttgcccaggctggagtgcaatggcacgatttccgttcactgcaacatctgcttcccgcgttcaagcgattctcctgcctcagccttgggagtagttgggattacagtgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgagaaacctgacagtactcctgatatcaccgtggccaacttccctacctgcacaactgctccagccctctgtcacacttcagtgattattcctcttgacctgtaattgttcagtggggaggactgtcccatacagattcactcccagagcctttaaaaagtgaagcctttgtgaaacaatgctagaataagagagaaagtaagggtgacagcaacccagaggccacagccagagtgctaagaccatcaaaagatgggaagagaaaaacattttggctaatgataacgggatattgggatactttagtaacaatgtggatgaatcacttgggtaacacaaggatgaggcttagtatgaacaaagcgctgtgtattatgacagtttgaaacctaataaggacacaaaatataaggcaagttatgataaatgatacaagttcagactcttctaagttctggccaataacaagtacaaacaaggattgtgcatccaatgaggatcaaagtatcaacttgattggtggtggaattgataacccccaacatggcaggctctctagtagaagcttggg

SEQ ID NO: 359413 - DNA, 1295 bp, Homo sapiens
aaataagatgcagagcccttctccaaacgatccggctagaaatctaggaagcgctgatccggagcgcacagagacagctgtgttgctcctctatcgcgggggtggtatggccagagtagtgagagaaggtgctctgttacaccagcaggaaataggtgctgtcctgggcctagaactccccgctcgctcctttgctcgcgcacacccggatccttcgtcgcggggaggatgtttccgcccggccgcggtgggcttgacgcaacgtccagcgcgcgcttttcatgccttggcgtttcctttggcggattttctgttttcggaagttgctgggttcgttttattcagcggcagtggtgctttcccgaatctcagaatgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaaggtaagtagttgtgttttagtttattacataaagatgctttcatcccattttgccaattaaaactaatcatcatgaatcctttttagtggttttcttttttcctcagagatccctgttctgaagtatgttcttttagaagatcacaaatctcatttgaaaagctttatattgcatttagcagaagatgatatctgatgagatcaacttctctgatgattgaactttttaaatgtcttttgaaatgcaatcttcaacataagatttgaattttgtctttttattaaaatttctttttgagaatacaaataggagcaacaatgcattaatatactgcagtttttagtgttgcactagaagcattgaaagttactttctaactagtattctggaaactttcagatcattaatatgctttgttctactatgaactcttatgtc

SEQ ID NO: 359414 - DNA, 2611 bp, Homo sapiens
ggaccacagctcctcccgtgcatccactcggcctgggaggttctggattttggctgtcgagggagtttgcctgcctctccagagaaagatggtcatgaggcccctgtggagtctgcttctctgggaagatgcagtgcccaggcccgtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacggacaggtgctgagcatttccctgggaccaggagacagagatgtggcctattcctgcattgtctccaaccctgtcagctgggacttggccacagtcacgccctgggatagctgtcatcatgaggcagcaccagggaaggcctcctacaaagatgtgctgctggtggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatatttgaactaatagaggaactctgagtcacccatgccagcatcagcttcagccccagaccctgcagtttgagatctgatgcttcctgagggccaaggcattgctgtaagaaaaggtctagaaataggtgaaagtgagaggtgggggacaggggtttctctttctggcctaaggactttcaggtaatcagagttcatgggccctcaaaggtaaattgcagttgtagacaccgaggatggttgacaacccatggttgagatgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgactccatcaaactttttattgtggccatcttaggaaaatacattctgcccctgaatgattctgtctagaaaagctctggagtattgatcactactggaaaaacacttaaggagctaaacttaccttcggggattattagctgataaggttcacagtttctctcacccaggtgtaactggattttttctggggcctcaatccagtcttgataacagcgaggaaagaggtattgaagaaacaggggtgggtttgaagtactattttccccagggtggcttcaatctccccacctaggatgtcagccctgtccaaggaccttccctcttctcccccagttccctgggcaatcacttcaccttggacaaaggatcagcacagctggcctccagatccacatcaccactcttccactcgattgttcccagatcctccctgcctggcctgctcagaggttccctgttggtaacctggctttatcaaattctcatccctttcccacacccacttctctcctatcaccttcccccaagattacctgaacagggtccatggccactcaacctgtcagcttgcaccatccccacctgccacctacagtcaggccacatgcctggtcactgaatcatgcaaaactggcctcagtccctaaaaatgatgtggaaaggaaagcccaggatctgacaatgagccctggtggatttgtggggaaaaaatacacagcactccccacctttctttcgttcatctccagggccccacctcagatcaaagcagctctggatgagatgggacctgcagctctccctccacaaggtgactcttagcaacctcatttcgacagtggtttgtagcgtggtgcaccagggccttgttgaacagatccacactgctctaataaagttcccatccttaatga

SEQ ID NO: 359415 - DNA, 2465 bp, Homo sapiens
ggaccacagctcctcccgtgcatccactcggcctgggaggttctggattttggctgtcgagggagtttgcctgcctctccagagaaagatggtcatgaggcccctgtggagtctgcttctctgggaagatgcagtgcccaggcccgtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacggacaggtgctgagcatttccctgggaccaggagacagagatgtggcctattcctgcattgtctccaaccctgtcagctgggacttggccacagtcacgccctgggatagctgtcatcatgaggcagcaccagggaaggcctcctacaaagatgtgctgctggtggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatatttgaactaatagaggaactctgagtcacccatgccagcatcagcttcagccccagaccctgcagtttgagatctgatgcttcctgagggccaaggcattgctgtaagaaaaggtctagaaataggtgaaagtgagaggtgggggacaggggtttctctttctggcctaaggactttcaggtaatcagagttcatgggccctcaaaggtaaattgcagttgtagacaccgaggatggttgacaacccatggttgagatgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgactccatcaaactttttattgtggccatcttaggaaaatacattctgcccctgaatgattctgtctagaaaagctctggagtattgatcactactggaaaaacacttaaggagctaaacttaccttcggggattattagctgataaggttcacagtttctctcacccaggtgtaactggattttttctggggcctcaatccagtcttgataacagcgaggaaagaggtattgaagaaacaggggtgggtttgaagtactattttccccagggtggcttcaatctccccacctaggatgtcagccctgtccaaggaccttccctcttctcccccagttccctgggcaatcacttcaccttggacaaaggatcagcacagctggcctccagatccacatcaccactcttccactcgattgttcccagatcctccctgcctggcctgctcagaggttccctgttggtaacctggctttatcaaattctcatccctttcccacacccacttctctcctatcaccttcccccaagattacctgaacagggtccatggccactcaacctgtcagcttgcaccatccccacctttctttcgttcatctccagggccccacctcagatcaaagcagctctggatgagatgggacctgcagctctccctccacaaggtgactcttagcaacctcatttcgacagtggtttgtagcgtggtgcaccagggccttgttgaacagatccacactgctctaataaagttcccatccttaatga

SEQ ID NO: 359416 - DNA, 2069 bp, Homo sapiens
ggaccacagctcctcccgtgcatccactcggcctgggaggttctggattttggctgtcgagggagtttgcctgcctctccagagaaagatggtcatgaggcccctgtggagtctgcttctctgggaagatgcagtgcccaggcccgtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacggacaggtgctgagcatttccctgggaccaggagacagagatgtggcctattcctgcattgtctccaaccctgtcagctgggacttggccacagtcacgccctgggatagctgtcatcatgaggcagcaccagggaaggcctcctacaaagatgtgctgctggtggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatatttgaactaatagaggaactctgagtcacccatgccagcatcagcttcagccccagaccctgcagtttgagatctgatgcttcctgagggccaaggcattgctgtaagaaaaggtctagaaataggtgaaagtgagaggtgggggacaggggtttctctttctggcctaaggactttcaggtaatcagagttcatgggccctcaaaggtaaattgcagttgtagacaccgaggatggttgacaacccatggttgagatgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgaggtccatggccactcaacctgtcagcttgcaccatccccacctgccacctacagtcaggccacatgcctggtcactgaatcatgcaaaactggcctcagtccctaaaaatgatgtggaaaggaaagcccaggatctgacaatgagccctggtggatttgtggggaaaaaatacacagcactccccacctttctttcgttcatctccagggccccacctcagatcaaagcagctctggatgagatgggacctgcagctctccctccacaaggtgactcttagcaacctcatttcgacagtggtttgtagcgtggtgcaccagggccttgttgaacagatccacactgctctaataaagttcccatccttaatga

SEQ ID NO: 359417 - DNA, 3181 bp, Homo sapiens
ggaccacagctcctcccgtgcatccactcggcctgggaggttctggattttggctgtcgagggagtttgcctgcctctccagagaaagatggtcatgaggcccctgtggagtctgcttctctgggaagccctacttcccattacagttactggtgcccaagtgctgagcaaagtcgggggctcggtgctgctggtggcagcgcgtccccctggcttccaagtccgtgaggctatctggcgatctctctggccttcagaagagctcctggccacgtttttccgaggctccctggagactctgtaccattcccgcttcctgggccgagcccagctacacagcaacctcagcctggagctcgggccgctggagtctggagacagcggcaacttctccgtgttgatggtggacacaaggggccagccctggacccagaccctccagctcaaggtgtacgatgcagtgcccaggcccgtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacggacaggtgctgagcatttccctgggaccaggagacagagatgtggcctattcctgcattgtctccaaccctgtcagctgggacttggccacagtcacgccctgggatagctgtcatcatgaggcagcaccagggaaggcctcctacaaagatgtgctgctggtggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatatttgaactaatagaggaactctgagtcacccatgccagcatcagcttcagccccagaccctgcagtttgagatctgatgcttcctgagggccaaggcattgctgtaagaaaaggtctagaaataggtgaaagtgagaggtgggggacaggggtttctctttctggcctaaggactttcaggtaatcagagttcatgggccctcaaaggtaaattgcagttgtagacaccgaggatggttgacaacccatggttgagatgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgactccatcaaactttttattgtggccatcttaggaaaatacattctgcccctgaatgattctgtctagaaaagctctggagtattgatcactactggaaaaacacttaaggagctaaacttaccttcggggattattagctgataaggttcacagtttctctcacccaggtgtaactggattttttctggggcctcaatccagtcttgataacagcgaggaaagaggtattgaagaaacaggggtgggtttgaagtactattttccccagggtggcttcaatctccccacctaggatgtcagccctgtccaaggaccttccctcttctcccccagttccctgggcaatcacttcaccttggacaaaggatcagcacagctggcctccagatccacatcaccactcttccactcgattgttcccagatcctccctgcctggcctgctcagaggttccctgttggtaacctggctttatcaaattctcatccctttcccacacccacttctctcctatcaccttcccccaagattacctgaacagggtccatggccactcaacctgtcagcttgcaccatccccacctgccacctacagtcaggccacatgcctggtcactgaatcatgcaaaactggcctcagtccctaaaaatgatgtggaaaggaaagcccaggatctgacaatgagccctggtggatttgtggggaaaaaatacacagcactccccacctttctttcgttcatctccagggccccacctcagatcaaagcagctctggatgagatgggacctgcagctctccctccacaaggtgactcttagcaacctcatttcgacagtggtttgtagcgtggtgcaccagggccttgttgaacagatccacactgctctaataaagttcccatccttaatgactcacttgtcaactagtggactaattaaccctccaccaaaaaaacacaaagtgcttctgtgagaccaattttgtgctaatgagcattgagactgatgctttgtaagtcacaccacaacaaatattgattgagggcgctgcatgtgctgggtacatttcttggcacttgggaatcagtagtcaagcgaaacccttgcctttgagagtttatggtctggataatataaataaacaagtaagcata

SEQ ID NO: 359418 - DNA, 2854 bp, Homo sapiens
ggaccacagctcctcccgtgcatccactcggcctgggaggttctggattttggctgtcgagggagtttgcctgcctctccagagaaagatggtcatgaggcccctgtggagtctgcttctctgggaagatgcagtgcccaggcccgtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacggacaggtgctgagcatttccctgggaccaggagacagagatgtggcctattcctgcattgtctccaaccctgtcagctgggacttggccacagtcacgccctgggatagctgtcatcatgaggcagcaccagggaaggcctcctacaaagatgtgctgctggtggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatatttgaactaatagaggaactctgagtcacccatgccagcatcagcttcagccccagaccctgcagtttgagatctgatgcttcctgagggccaaggcattgctgtaagaaaaggtctagaaataggtgaaagtgagaggtgggggacaggggtttctctttctggcctaaggactttcaggtaatcagagttcatgggccctcaaaggtaaattgcagttgtagacaccgaggatggttgacaacccatggttgagatgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgactccatcaaactttttattgtggccatcttaggaaaatacattctgcccctgaatgattctgtctagaaaagctctggagtattgatcactactggaaaaacacttaaggagctaaacttaccttcggggattattagctgataaggttcacagtttctctcacccaggtgtaactggattttttctggggcctcaatccagtcttgataacagcgaggaaagaggtattgaagaaacaggggtgggtttgaagtactattttccccagggtggcttcaatctccccacctaggatgtcagccctgtccaaggaccttccctcttctcccccagttccctgggcaatcacttcaccttggacaaaggatcagcacagctggcctccagatccacatcaccactcttccactcgattgttcccagatcctccctgcctggcctgctcagaggttccctgttggtaacctggctttatcaaattctcatccctttcccacacccacttctctcctatcaccttcccccaagattacctgaacagggtccatggccactcaacctgtcagcttgcaccatccccacctgccacctacagtcaggccacatgcctggtcactgaatcatgcaaaactggcctcagtccctaaaaatgatgtggaaaggaaagcccaggatctgacaatgagccctggtggatttgtggggaaaaaatacacagcactccccacctttctttcgttcatctccagggccccacctcagatcaaagcagctctggatgagatgggacctgcagctctccctccacaaggtgactcttagcaacctcatttcgacagtggtttgtagcgtggtgcaccagggccttgttgaacagatccacactgctctaataaagttcccatccttaatgactcacttgtcaactagtggactaattaaccctccaccaaaaaaacacaaagtgcttctgtgagaccaattttgtgctaatgagcattgagactgatgctttgtaagtcacaccacaacaaatattgattgagggcgctgcatgtgctgggtacatttcttggcacttgggaatcagtagtcaagcgaaacccttgcctttgagagtttatggtctggataatataaataaacaagtaagcata

SEQ ID NO: 359419 - DNA, 1999 bp, Homo sapiens
  misc_feature (35)..(35): n is a, c, g, or t
  misc_feature (87)..(87): n is a, c, g, or t
  misc_feature (92)..(92): n is a, c, g, or t
ggaagaggggggaagagggacacggggaagggagnaggggaaaaaggggggggggggaagggggagaagaggccaggggaagagagnagganaaccaagggacagaaaagagcgcaaggccacccgggcaggccgaggaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatatttgaactaatagaggaactctgagtcacccatgccagcatcagcttcagccccagaccctgcagtttgagatctgatgcttcctgagggccaaggcattgctgtaagaaaaggtctagaaataggtgaaagtgagaggtgggggacaggggtttctctttctggcctaaggactttcaggtaatcagagttcatgggccctcaaaggtaaattgcagttgtagacaccgaggatggttgacaacccatggttgagatgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgactccatcaaactttttattgtggccatcttaggaaaatacattctgcccctgaatgattctgtctagaaaagctctggagtattgatcactactggaaaaacacttaaggagctaaacttaccttcggggattattagctgataaggttcacagtttctctcacccaggtgtaactggattttttctggggcctcaatccagtcttgataacagcgaggaaagaggtattgaagaaacaggggtgggtttgaagtactattttccccagggtggcttcaatctccccacctaggatgtcagccctgtccaaggaccttccctcttctcccccagttccctgggcaatcacttcaccttggacaaaggatcagcacagctggcctccagatccacatcaccactcttccactcgattgttcccagatcctccctgcctggcctgctcagaggttccctgttggtaacctggctttatcaaattctcatccctttcccacacccacttctctcctatcaccttcccccaagattacctgaacagggtccatggccactcaacctgtcagcttgcaccatccccacctgccacctacagtcaggccacatgcctggtcactgaatcatgcaaaactggcctcagtccctaaaaatgatgtggaaaggaaagcccaggatctgacaatgagccctggtggatttgtggggaaaaaatacacagcactccccacctttctttcgttcatctccagggccccacctcagatcaaagcagctctggatgagatgggacctgcagctctccctccacaaggtgactcttagcaacctcatttcgacagtggtttgtagcgtggtgcaccagggccttgttgaacagatccacactgctctaataaagttcccatccttaatga

SEQ ID NO: 359420 - DNA, 2104 bp, Homo sapiens
ggaccacagctcctcccgtgcatccactcggcctgggaggttctggattttggctgtcgagggagtttgcctgcctctccagagaaagatggtcatgaggcccctgtggagtctgcttctctgggaagatgcagtgcccaggcccgtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacggacaggtgctgagcatttccctgggaccaggagacagagatgtggcctattcctgcattgtctccaaccctgtcagctgggacttggccacagtcacgccctgggatagctgtcatcatgaggcagcaccagggaaggcctcctacaaagatgtgctgctggtggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatatttgaactaatagaggaactctgagtcacccatgccagcatcagcttcagccccagaccctgcagtttgagatctgatgcttcctgagggccaaggcattgctgtaagaaaaggtctagaaataggtgaaagtgagaggtgggggacaggggtttctctttctggcctaaggactttcaggtaatcagagttcatgggccctcaaaggtaaattgcagttgtagacaccgaggatggttgacaacccatggttgagatgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgactccatcaaactttttattgtggccatcttaggaaaatacattctgcccctgaatgattctgtctagaaaagctctggagtattgatcactactggaaaaacacttaaggagctaaacttaccttcggggattattagctgataaggttcacagtttctctcacccaggtgtaactggattttttctggggcctcaatccagtcttgataacagcgaggaaagaggtacttggagaaccggggtggttgagtaaaattcccagggggtgatatcccacaaggagtgacggcgaggcctccctctccattcggcaaaccccgggcaagagaccggtggaaaccaaaccgccacgggcaaacgcgcgcgaacgggaacatactaaacaattaccagggggcacagacgcc

SEQ ID NO: 359421 - DNA, 1034 bp, Homo sapiens
ggaccacagctcctcccgtgcatccactcggcctgggaggttctggattttggctgtcgagggagtttgcctgcctctccagagaaagatggtcatgaggcccctgtggagtctgcttctctgggaagccctacttcccattacagttactggtgcccaagtgctgagcaaagtcgggggctcggtgctgctggtggcagcgcgtccccctggcttccaagtccgtgaggctatctggcgatctctctggccttcagaagagctcctggccacgtttttccgaggctccctggagactctgtaccattcccgcttcctgggccgagcccagctacacagcaacctcagcctggagctcgggccgctggagtctggagacagcggcaacttctccgtgttgatggtggacacaaggggccagccctggacccagaccctccagctcaaggtgtacgatgcagtgcccaggcccgtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacggacaggtgctgagcatttccctgggaccaggagacagagatgtggcctattcctgcattgtctccaaccctgtcagctgggacttggccacagtcacgccctgggatagctgtcatcatgaggcagcaccagggaaggcctcctacaaagatgtgctgctggtggtggtgcctgtctcgctgctcctgatgctggttactctcttctctgcctggcactggtgcccctgctcagggccccacctcagatcaaagcagctctggatgagatgggacctgcagctctccctccacaaggtgactcttagcaacctcatttcgacagtggtttgtagcgtggtgcaccagggccttgttgaacagatccacactgctctaataaagttcccatccttaatga

SEQ ID NO: 359422 - DNA, 460 bp, Homo sapiens
tcaccacagtccccgcccctccctctagtacccccggacctgggggctcaatgtcacttgtcatcatggcgctttccctcccagttctataggggtgcagttaagagaaaagtgaagtatttcttgaaactgtgtctctatcaaaaagaaggaaacaaaagatcaaccgaaatgaccacttgtttaaacattaatagtacatagcatgattgctttgtggcagagcaaaaaatttctatgaatttcatatgcaaagagaatacgtcagtgttgaaaatcgctggccccttcactctctgaggttaccttccccttctctgccagtgttacacttgccatccctgcgtgccaaggccatagtttccacttatttttttaaggcagcattaaacttatttgacctacatctgcccccctcctgtgaaacttgaaatgctattaaaccaaattaagaagtttt

SEQ ID NO: 359423 - DNA, 323 bp, Homo sapiens
cacagtattgcactaaagaagcaagccataaaagattacataaaatataactttcttgtattcttatacagtttaaaacaagttaaaactaaactatgtagtttaagtttgtgcacataggtagtaaaactaaaggagcaaaaggaatgatcacagaagtcagattagtgttccatctggtggtaggagagggacaatgaacttggaggaacatatggaggacttcaattattggcaacattctatttcttaatctgttgctgatctgattgttccctttataattattatttaaattgtacatatgcttttagatacatttt

SEQ ID NO: 359424 - DNA, 508 bp, Homo sapiens
atagcccctaactatctagagaaaattgttcaaagttcttagcctgttttcattcttgcaaattcatttccattgccttcctatgtatcccctccctgccagctagccttttctacttctaaacgcaccacgcaatttcccgccttggtatttttgcttgagccattcctcctacatgaaatgtcttccccctcacttgtatttatgtaaggtcttacttttatgagcctgattacagtcatcttgccatacagatcctcctcttcggaagcattttctgcttaggtcttttggaacttttagtgctccaagaagattcaagcctcttcctccagtgccaaaggggtcccatctccctttgtctgccatgccacagcttccagatcttgtctgaacacacccatctgctttccagtttgagagaaaatgactacttcccaaatatacccaccatataccccacaccttgagacactgtttccagcatgcttactacctgtcaacaccc

SEQ ID NO: 359425 - DNA, 1239 bp, Homo sapiens
ggaatcacatcgagccactgaaaattcagtggctcgatgtgcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359426 - DNA, 877 bp, Homo sapiens
  misc_feature (28)..(28): n is a, c, g, or t
tggctagtacgaggctcggttaatcggncgagggtctgccaccgctccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagaggttgaaagaaccccgtcgtcttcatttatactaaccatactcttagagggaagcaatctggttttgtgcagaggcacctgagggaggcaggaccctgggaacttcccccagccacatggttgattgtgtgacgttgggcaagtcacattttgctgcactatcaccttcagatcatgag

SEQ ID NO: 359427 - DNA, 1722 bp, Homo sapiens
ttgcctaacatcaggaacgtgcttaatgcttctgaattgcacacaaaaatggcaagtttaatattatgtgtactttatcacaatgaaaaaagctgctgcgtgggccaagttacttgtgcaggtaagtgttctgcaggtcgttgcctgcacctcagttgtagggtgtccgtaggatgtgaggccagtccccgggcttaatgatgctttaaatcctgcctagtattcaattatttcttgtcgcttaaaaggcctaataaaattatggttttagtttacagtggtatgaatgcttagctgttggattttagtaggaaagtttgtccctttttgtttttaattttgttttacagattcacaggaatttttttttttttttttttttaatgcacagaaagtttccctggacacactacccagtttcccccagtgataatatcttgggtaacatcctgtatacattcacattggtgcattcctcagagttgtcagattttgctagttttacgtgcacttgtgtatgtgtgtatttgcaattttagcacgtgtagactcttgtaaccactacaatcaagttacagaactacactaccaaggttcatctttttaaaatctttgatgttacctttttcggaacagtgaccatgagaggactttcctcccaaaattttgagaactactgaaccagaatatagtctgacactaataggtagaaatttaaccaaaggagattatgaagctctgcacttcagttaacaaatcacttctcagcttccagttccatctcagaaggaaggaaagggattaaaatccagagaccagaaatgggagcaaagtacaaggtggtgtaatcattacagaggtttcctgatgtttccaagtcagtcgtgtgttgagctgctaaactctaaagtaattttaggtggaagtgttggaaacatgctgctgaggtgatagaaaggaatccatggtcctctgttagttggaaagtatatggaatactatattctacataagatacaacactctctgtgagacaaggataaagtagattttgtcagtgaaattgtgacaagaatcgctgatgggtttagagcctaagtttgcgaggagcactggaagaaattaagattgttgagattggaaagggttagctatggggggaacaggaggaggtgactccatgacagaccaaatattcaaaggactgtgtagaagaggaaaaagactttgttagggctccagaggacagagccaggagtcagacagggccttgaactcaacccaccgagatctgcaaactttgcaggatgcaccagatgtcttgtagccatgggtcaaggggggaccctgggtaagagactgtaatagatgacctctaaggccatctcatgacatgtgtgattaatgtatgtacctgtcctctctttttgacaattctacagattattcaggacagggagttgaccaactgcaaagagtgattgacaccatcaaaaccaaccctgacgacagaagaatcatcatgtgcgcttggaatccaagaggttgaaagaaccccgtcgtcttcatttatactaaccatactcttagagggaagcaatctggttttgtgcagaggcacctgagggaggcaggaccctgggaacttcccccagccacatggttgattgtgtgacgttgggcaagtcacattttgctgcactatcaccttcagatcatgag

SEQ ID NO: 359428 - DNA, 1675 bp, Homo sapiens
ttgcctaacatcaggaacgtgcttaatgcttctgaattgcacacaaaaatggcaagtttaatattatgtgtactttatcacaatgaaaaaagctgctgcgtgggccaagttacttgtgcaggtaagtgttctgcaggtcgttgcctgcacctcagttgtagggtgtccgtaggatgtgaggccagtccccgggcttaatgatgctttaaatcctgcctagtattcaattatttcttgtcgcttaaaaggcctaataaaattatggttttagtttacagtggtatgaatgcttagctgttggattttagtaggaaagtttgtccctttttgtttttaattttgttttacagattcacaggaatttttttttttttttttttttaatgcacagaaagtttccctggacacactacccagtttcccccagtgataatatcttgggtaacatcctgtatacattcacattggtgcattcctcagagttgtcagattttgctagttttacgtgcacttgtgtatgtgtgtatttgcaattttagcacgtgtagactcttgtaaccactacaatcaagttacagaactacactaccaaggttcatctttttaaaatctttgatgttacctttttcggaacagtgaccatgagaggactttcctcccaaaattttgagaactactgaaccagaatatagtctgacactaataggtagaaatttaaccaaaggagattatgaagctctgcacttcagttaacaaatcacttctcagcttccagttccatctcagaaggaaggaaagggattaaaatccagagaccagaaatgggagcaaagtacaaggtggtgtaatcattacagaggtttcctgatgtttccaagtcagtcgtgtgttgagctgctaaactctaaagtaattttaggtggaagtgttggaaacatgctgctgaggtgatagaaaggaatccatggtcctctgttagttggaaagtatatggaatactatattctacataagatacaacactctctgtgagacaaggataaagtagattttgtcagtgaaattgtgacaagaatcgctgatgggtttagagcctaagtttgcgaggagcactggaagaaattaagattgttgagattggaaagggttagctatggggggaacaggaggaggtgactccatgacagaccaaatattcaaaggactgtgtagaagaggaaaaagactttgttagggctccagaggacagagccaggagtcagacagggccttgaactcaacccaccgagatctgcaaactttgcaggatgcaccagatgtcttgtagccatgggtcaaggggggaccctgggtaagagactgtaatagatgacctctaaggccatctcatgacatgtgtgattaatgtatgtacctgtcctctctttttgacaattctacagattattcaggacagggagttgaccaactgcaaagagtgattgacaccatcaaaaccaaccctgacgacagaagaatcatcctagtgagtgtgatgtggtatctcattgtggttttgctttgcatttccctaatggctgatggggttgactatcttttatatataacttaatttttctattaggtaacattcacaattatttttaatatcagctgccatgattgccagatgaga

SEQ ID NO: 359429 - DNA, 1375 bp, Homo sapiens
cttcccaggctcaagccattctcctgcctcagcctcctgagtagctgggattacaggcacacatcaccgcgccctgctaattttttttttttttctgagatggagtctcgctctgtcacccaggctggagtgcagtggtgcgattttggctcactgcaagctcctcctcctgggttcacgccattctcctgcctcagcctctccgagtagctgggactataggtgggcggatcacgaggtcagaagatcgagaccagctaatttttgtatttttagtagagacgaggtttcaccatgttggccaggctggtctcaaactcctgacctcaggtgatccacccacctcggcctcccaaagtgctggggttacaggtgtgagccactatgcctggccactatgccgttctttcatcggagaagctgcagtggctcactctgactggctgcatcctctgagtggacagaccccataatccagccccacgtggcagcctgtccctggcatgtgccctgtgctccctggggcatctccactgcccccgcctggacctgcaggctctgcagctgctccttcctcagatactcctaaggggatggcctccctcatgtaagcaaaacctgggagggttagagccctgaggagcttcctgtgagatgctcaggtaggcagagatcaggttggtgctaggccagctggcattcagcagggcacagccaacctgaaagagccctaaggaggaaaaagcaagtgggacccaaggtgaaaagtcttgtttccccggggctcctcacctgagattcctattgtggaatgattcctcagaaaatttgggctctgtttaaataatgaaggctgtggtcgctccatggctcctgctcacccttccctcacctgaggcttagctttccttatggagtcagctctggccatctccctcgtcccagcccacacccaacgttctcctcaatgaacttttctactgtgcttggcattcagtgccctggcccagtatcctccggtctttgtttcacatatctcggctgttctctccagcgaggctgcaatgtggaaggggagggcatttctgaaacccaggctttggcagagtatcccacataatgtagatcatgtgctgatttgctgagagaaacagagaactggtccctgagtccccgactccacacctccagtacgacccatgaatttatgtgggatgcatcaaggtgtccctcctagaactggaaccaagactgctccatcagagttaaaggtgtaagatcaacacaaaatggggagtgtatagctatgcaaagtcacctcaggaaaaaatgttcctaggcaggcaggatgtggctataagccacatgaatgtac

SEQ ID NO: 359430 - DNA, 556 bp, Homo sapiens
accgtcctgccgtcctggatcctgcgccagctgcgcgggggaggggactcgaaggtgtgtgagccaggggctgaccttgaccgctcagataaatggagcgcagccttgacacaggggtggaggtggttttgaatggggaaacccattcgtggtgaagcagattcactgtagctagcggaaaagccctccggcccacggacccatctagagacgaatacatagcagctgctgtggctgattggcgtgggacagcgtggggagttttgtctgaggagagggatccacttttctgcagctccaagcccaggggcctttgatgagccatagacctcatttttaacccacctttctgcttagacattgagcaagttacttctcatatagcttccctatatgttaaaaatggagaaaataatgcttagtaggcaattctgataaaagcaggtgcttgcaaaaatctctctgttgtctgaatataaactgtaccacaagcgagtgcggatgaacgaggactgcatttaaagataagttttacactttcatttctccgtgcctc

SEQ ID NO: 359431 - DNA, 444 bp, Homo sapiens
cccgtttagtcctaacctcaatcctggggcagatccaacacatcctccgctgcggcgtcaggaaggacgaccgcacgggcaccggcaccctgtcggtattcggcatgcaggcgcgctacagcctgagaggtgacgccgcgggcccctgcgggacgggtggcgggaaggagggaggcgcggctggggagagcgctcgggagctgccgggcgctgcggaccccgtttagtcctaacctcaatcctgcgagggaggggacgcatcgtcctcctcgccttacagacgccgaaacggagggtcccattagggacgtgactggcgcgggcaacacacacagcagcgacagccgggaggtaagccgcgtcccagcggctccgcggccgggctcgcagtcgccccagtgatgccgtggcccccgaggcgggcgtcatcgggcagcgtttgcc

SEQ ID NO: 359432 - DNA, 2148 bp, Homo sapiens
cgcgggacggccgcgggaaaaggcgcgcggaaggggtcctgccaccgcgccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359433 - DNA, 2110 bp, Homo sapiens
caaaaaaaataaagctaggacgaggctggtggaattggacaaggtgacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359434 - DNA, 2320 bp, Homo sapiens
accgtcctgccgtcctggatcctgcgccagctgcgcgggggaggggactcgaaggtgtgtgagccaggggctgaccttgaccgctcagataaatggagcgcagccttgacacaggggtggaggtggttttgaatggggaaacccattcgtggtgaagcagattcactgtagctagcggaaaagccctccggcccacggacccatctagagacgaatacatagcagctgctgtggctgattggcgtgggacagcgtggggagttttgtctgaggagagggatccacttttctgcagctccaagcccaggggcctttgatgagccatagacctcatttttaacccacctttctgcttagacattgagcaagttacttctcatatagcttccctatatgttaaaaatggagaaaataatgcttagtaggcaattctgataaaagcaggtgcttgcaaaaatctctctgttgtctgaatataaactgtaccacaagcgagtgcggatgaacgaggactgcatttaaaatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359435 - DNA, 1203 bp, Homo sapiens
  misc_feature (1150)..(1150): n is a, c, g, or t
  misc_feature (1157)..(1157): n is a, c, g, or t
  misc_feature (1160)..(1160): n is a, c, g, or t
cgcgggacggccgcgggaaaaggcgcgcggaaggggtcctgccaccgcgccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggatgcgggaaaatntttggtnaanaaagctgggcaattgtcgggcatcataattagagtggccgggg

SEQ ID NO: 359436 - DNA, 2660 bp, Homo sapiens
cgcgggacggccgcgggaaaaggcgcgcggaaggggtcctgccaccgcgccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaaggtgggctgtctcgggaagggtgacttgccagcctaccacactgagctcttcagttctttaatatgggaaaacaaattgcagagtttagtctctgattagcttttaaatttgatatgtgtaagtaagaaatgaaccagcttttactttgaaaccttcctcttctggaaggttttctggccctgtggtatacgcactaacagatctatacaggttgtttgtgatacagcttctatggattttctcaaaagctatgctgaggttgggtatggtggctcatgcctgtaatcccagcactttgggagactgagacaggagcaattgcttgaggtctggagttcaataccagcctgggcaacataacaagatgctgttgctacaaaaaaatggaaaagctacactaaattatttttttaaaaaaagccttgcggtgtctgcatattctaatgtttttaaatgatgttttaaagaattgaaactaacatactgttctgctttctcccccgggtttatagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359437 - DNA, 2380 bp, Homo sapiens
cgcgggacggccgcgggaaaaggcgcgcggaaggggtcctgccaccgcgccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaaggtgggctgtctcgggaagggtgacttgccagcctaccacactgagctcttcagttcctgatgaggcaccaggctcctgatgctgtgtaatgtcacaaaatacccctcactctcgatctgtgcaagagaacagctggttgcgctccaatcatgttacataacctacggcaaggtatcgacaggatcatactcctgtaaaatagaactttgttgatcacatcctgtgtacttgtttcacggacatgaggagcaattacaacaggtcgtacaattatggcaaaataatggccttattttgtttttagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359438 - DNA, 2221 bp, Homo sapiens
cgcgggacggccgcgggaaaaggcgcgcggaaggggtcctgccaccgcgccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatggcaggacagctcactgttcaccacatagaactggcagagggcatggcagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359439 - DNA, 2990 bp, Homo sapiens
ttgcctaacatcaggaacgtgcttaatgcttctgaattgcacacaaaaatggcaagtttaatattatgtgtactttatcacaatgaaaaaagctgctgcgtgggccaagttacttgtgcaggtaagtgttctgcaggtcgttgcctgcacctcagttgtagggtgtccgtaggatgtgaggccagtccccgggcttaatgatgctttaaatcctgcctagtattcaattatttcttgtcgcttaaaaggcctaataaaattatggttttagtttacagtggtatgaatgcttagctgttggattttagtaggaaagtttgtccctttttgtttttaattttgttttacagattcacaggaatttttttttttttttttttttaatgcacagaaagtttccctggacacactacccagtttcccccagtgataatatcttgggtaacatcctgtatacattcacattggtgcattcctcagagttgtcagattttgctagttttacgtgcacttgtgtatgtgtgtatttgcaattttagcacgtgtagactcttgtaaccactacaatcaagttacagaactacactaccaaggttcatctttttaaaatctttgatgttacctttttcggaacagtgaccatgagaggactttcctcccaaaattttgagaactactgaaccagaatatagtctgacactaataggtagaaatttaaccaaaggagattatgaagctctgcacttcagttaacaaatcacttctcagcttccagttccatctcagaaggaaggaaagggattaaaatccagagaccagaaatgggagcaaagtacaaggtggtgtaatcattacagaggtttcctgatgtttccaagtcagtcgtgtgttgagctgctaaactctaaagtaattttaggtggaagtgttggaaacatgctgctgaggtgatagaaaggaatccatggtcctctgttagttggaaagtatatggaatactatattctacataagatacaacactctctgtgagacaaggataaagtagattttgtcagtgaaattgtgacaagaatcgctgatgggtttagagcctaagtttgcgaggagcactggaagaaattaagattgttgagattggaaagggttagctatggggggaacaggaggaggtgactccatgacagaccaaatattcaaaggactgtgtagaagaggaaaaagactttgttagggctccagaggacagagccaggagtcagacagggccttgaactcaacccaccgagatctgcaaactttgcaggatgcaccagatgtcttgtagccatgggtcaaggggggaccctgggtaagagactgtaatagatgacctctaaggccatctcatgacatgtgtgattaatgtatgtacctgtcctctctttttgacaattctacagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359440 - DNA, 1622 bp, Homo sapiens
cgcgggacggccgcgggaaaaggcgcgcggaaggggtcctgccaccgcgccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaaggtgggctgtctcgggaagggtgacttgccagcctaccacactgagctcttcagttcctgatgaggcaccaggctcctgatgctgtgtaatgtcacaaaatacccctcactctcgatctgtgcaagagaacagctggttgcgctccaatcatgttacataacctacggcaaggtatcgacaggatcatactcctgtaaaatagaactttgttgatcacatcctgtgtacttgtttcacggacatgaggagcaattacaacaggtcgtacaattatggcaaaataatggccttattttgtttttagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctttagctgattcctgagggtggtatgacttctagctgaactcatcttgatcggtaggattttttaaatccatttttgtaaaactatttccaagaaattttaagccctttcacttcagaaagaaaaaagttgttggggctgagcacttaattttcttgagcaggaaggagtttcttccaaacttcaccatctggatactggtgtttctttacagattcctccttc

SEQ ID NO: 359441 - DNA, 1430 bp, Homo sapiens
cgcgggacggccgcgggaaaaggcgcgcggaaggggtcctgccaccgcgccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaaggtgggctgtctcgggaagggtgacttgccagcctaccacactgagctcttcagttcctgatgaggcaccaggctcctgatgctgtgtaatgtcacaaaatacccctcactctcgatctgtgcaagagaacagctggttgcgctccaatcatgttacataacctacggcaaggtatcgacaggatcatactcctgtaaaatagaactttgttgatcacatcctgtgtacttgtttcacggacatgaggagcaattacaacaggtcgtacaattatggcaaaataatggccttattttgtttttagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctttagctgattcctgaaggtctcttgggcaag

SEQ ID NO: 359442 - DNA, 2076 bp, Homo sapiens
ttgagacacagtctcaccctgttgcccaggctggagtgcagtggtgtgatctccgctcacggcaacctccatctcccaggttcaagtgagttcccattcctcagccccagagctgggaccacaggcgcgcgaatttttgtatttttagcagagacggggtttcactatgttggccaggctagtctcgaactcaagttggcctcaagtgatctgcccaccctggcgtcccagtgttgggatttcaggcatgagccactgtgcctggccatgtaatagagacttttaatataggagggtgtaccagaagcaccagtttcctgtggcaaacagaattattcctgctgtatttgtaatctggtgccacgaggtagcccagatcccttcagctctgatggaagagcattgcttcagccgtaaatggacacctgcagaaaccttgcaccgatggatagtctccctcagctccgtgccatcgctgcagaggctgttatggacatcactgcagcccagtggctctctctcctggtctccaccatatgagttggcttctgtttctctcctgttttactttgcctttagctgtggtctttcaaaccaccatccctccttatcttcctctgctggttcctcatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359443 - DNA, 2749 bp, Homo sapiens
accaatttgacctttctgcagtatttctagggcatcctcctcagtcaggacatcagtgatgtacctgaaatctatgcaggataccagcgtcctgggatcctggcaacgtgacaggaggggaagaggcctgaatcaattataaggtgggttatattttgttttttaaaattttttttttttttttttgagacagagttttgctctgttgcccaggctggaatgcaacggcgtgatcttggctcactgtaacctctgcctcctgggttcgagtgattctcctgcctcagcctcccaagtagctgggattacaggcatgtgccaccatgcccggctaattttgtatttttagtagagacggggtttcacaatgttgtccaggttgtcttgaactcctgacctcagatgatctgcctgcctcagcctcccaaccagatgatcttaatttgtgtatttatactcattcttacaccaaaaagggttttaaattgcctagaaactacatgtaagatgttaacattttaaatggaagcagatgaagttccagctcgctgccacctcactaacatttttaacaattatattgtaaaattcaactctaccagggtgtagagccaggtgtggtggctcacacctgtaattccaacaactccagaggccaaggcgagaggatcatttgaacccaggaatttgaggctgtagtgagtcatgatcacgccattgcactccagctcacggcaacctccatctcccaggttcaagtgagttcccattcctcagccccagagctgggaccacaggcgcgcgaatttttgtatttttagcagagacggggtttcactatgttggccaggctagtctcgaactcaagttggcctcaagtgatctgcccaccctggcgtcccagtgttgggatttcaggcatgagccactgtgcctggccatgtaatagagacttttaatataggagggtgtaccagaagcaccagtttcctgtggcaaacagaattattcctgctgtatttgtaatctggtgccacgaggtagcccagatcccttcagctctgatggaagagcattgcttcagccgtaaatggacacctgcagaaaccttgcaccgatggatagtctccctcagctccgtgccatcgctgcagaggctgttatggacatcactgcagcccagtggctctctctcctggtctccaccatatgagttggcttctgtttctctcctgttttactttgcctttagctgtggtctttcaaaccaccatccctccttatcttcctctgctggttcctcatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359444 - DNA, 2170 bp, Homo sapiens
aaatatgcatagtacgaggcctgggtgttatctctaccagggtgtagagccaggtgtggtggctcacacctgtaattccaacaactccagaggccaaggcgagaggatcatttgaacccaggaatttgagtgcagtggtgtgatctccgctcacggcaacctccatctcccaggttcaagtgagttcccattcctcagccccagagctgggaccacaggcgcgcgaatttttgtatttttagcagagacggggtttcactatgttggccaggctagtctcgaactcaagttggcctcaagtgatctgcccaccctggcgtcccagtgttgggatttcaggcatgagccactgtgcctggccatgtaatagagacttttaatataggagggtgtaccagaagcaccagtttcctgtggcaaacagaattattcctgctgtatttgtaatctggtgccacgaggtagcccagatcccttcagctctgatggaagagcattgcttcagccgtaaatggacacctgcagaaaccttgcaccgatggatagtctccctcagctccgtgccatcgctgcagaggctgttatggacatcactgcagcccagtggctctctctcctggtctccaccatatgagttggcttctgtttctctcctgttttactttgcctttagctgtggtctttcaaaccaccatccctccttatcttcctctgctggttcctcatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359445 - DNA, 891 bp, Homo sapiens
  misc_feature (838)..(838): n is a, c, g, or t
  misc_feature (869)..(869): n is a, c, g, or t
  misc_feature (884)..(884): n is a, c, g, or t
cgcgggacggccgcgggaaaaggcgcgcggaaggggtcctgccaccgcgccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacaattcggcccaggnttaccgccccttgggtttaaccgttacccantggaatttggccggncaaccaa

SEQ ID NO: 359446 - DNA, 2308 bp, Homo sapiens
ttgagacacagtctcaccctgttgcccaggctggagtgcagtggtgtgatctccgctcacggcaacctccatctcccaggttcaagtgagttcccattcctcagccccagagctgggaccacaggcgcgcgaatttttgtatttttagcagagacggggtttcactatgttggccaggctagtctcgaactcaagttggcctcaagtgatctgcccaccctggcgtcccagtgttgggatttcaggcatgagccactgtgcctggccatgtaatagagacttttaatataggagggtgtaccagaagcaccagtttcctgtggcaaacagaattattcctgctgtatttgtaatctggtgccacgaggtagcccagatcccttcagctctgatggaagagcattgcttcagccgtaaatggacacctgcagaaaccttgcaccgatggatagtctccctcagctccgtgccatcgctgcagaggctgttatggacatcactgcagcccagtggctctctctcctggtctccaccatatgagttggcttctgtttctctcctgttttactttgcctttagctgtggtctttcaaaccaccatccctccttatcttcctctgctggttcctcatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaaggtgggctgtctcgggaagggtgacttgccagcctaccacactgagctcttcagttcctgatgaggcaccaggctcctgatgctgtgtaatgtcacaaaatacccctcactctcgatctgtgcaagagaacagctggttgcgctccaatcatgttacataacctacggcaaggtatcgacaggatcatactcctgtaaaatagaactttgttgatcacatcctgtgtacttgtttcacggacatgaggagcaattacaacaggtcgtacaattatggcaaaataatggccttattttgtttttagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359447 - DNA, 880 bp, Homo sapiens
cgcgggacggccgcgggaaaaggcgcgcggaaggggtcctgccaccgcgccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagaggttgaaagaaccccgtcgtcttcatttatactaaccatactcttagagggaagcaatctggttttgtgcagaggcacctgagggaggcaggaccctgggaacttcccccagccacatggttgattgtgtgacgttgggcaagtcacattttgctgcactatcaccttcagatcatgag

SEQ ID NO: 359448 - DNA, 1493 bp, Homo sapiens
accaatttgacctttctgcagtatttctagggcatcctcctcagtcaggacatcagtgatgtacctgaaatctatgcaggataccagcgtcctgggatcctggcaacgtgacaggaggggaagaggcctgaatcaattataaggtgggttatattttgttttttaaaattttttttttttttttttgagacagagttttgctctgttgcccaggctggaatgcaacggcgtgatcttggctcactgtaacctctgcctcctgggttcgagtgattctcctgcctcagcctcccaagtagctgggattacaggcatgtgccaccatgcccggctaattttgtatttttagtagagacggggtttcacaatgttgtccaggttgtcttgaactcctgacctcagatgatctgcctgcctcagcctcccaaccagatgatcttaatttgtgtatttatactcattcttacaccaaaaagggttttaaattgcctagaaactacatgtaagatgttaacattttaaatggaagcagatgaagttccagctcgctgccacctcactaacatttttaacaattatattgtaaaattcaactctaccagggtgtagagccaggtgtggtggctcacacctgtaattccaacaactccagaggccaaggcgagaggatcatttgaacccaggaatttgaggctgtagtgagtcatgatcacgccattgcactccagctcacggcaacctccatctcccaggttcaagtgagttcccattcctcagccccagagctgggaccacaggcgcgcgaatttttgtatttttagcagagacggggtttcactatgttggccaggctagtctcgaactcaagttggcctcaagtgatctgcccaccctggcgtcccagtgttgggatttcaggcatgagccactgtgcctggccatgtaatagagacttttaatataggagggtgtaccagaagcaccagtttcctgtggcaaacagaattattcctgctgtatttgtaatctggtgccacgaggtagcccagatcccttcagctctgatggaagagcattgcttcagccgtaaatggacacctgcagaaaccttgcaccgatggatagtctccctcagctccgtgccatcgctgcagaggctgttatggacatcactgcagcccagtggctctctctcctggtctccaccatatgagttggcttctgtttctctcctgttttactttgcctttagctgtggtctttcaaaccaccatccctccttatcttcctctgctggttcctcctccagtacgacccatgaatttatgtgggatgcatcaaggtgtccctcctagaactggaaccaagactgctccatcagagttaaaggtgtaagatcaacacaaaatggggagtgtatagctatgcaaagtcacctcaggaaaaaatgttcctaggcaggcaggatgtggctataagccacatgaatgtac

SEQ ID NO: 359449 - DNA, 776 bp, Homo sapiens
accaatttgacctttctgcagtatttctagggcatcctcctcagtcaggacatcagtgatgtacctgaaatctatgcaggataccagcgtcctgggatcctggcaacgtgacaggaggggaagaggcctgaatcaattataaggtgggttatattttgttttttaaaattttttttttttttttttgagacagagttttgctctgttgcccaggctggaatgcaacggcgtgatcttggctcactgtaacctctgcctcctgggttcgagtgattctcctgcctcagcctcccaagtagctgggattacaggcatgtgccaccatgcccggctaattttgtatttttagtagagacggggtttcacaatgttgtccaggttgtcttgaactcctgacctcagatgatctgcctgcctcagcctcccaaccagatgatcttaatttgtgtatttatactcattcttacaccaaaaagggttttaaattgcctagaaactacatgtaagatgttaacattttaaatggaagcagatgaagttccagctcgctgccacctcactaacatttttaacaattatattgtaaaattcaactctaccagggtgtagagccaggtgtggtggctcacacctgtaattccaacaactccagaggccaaggcgagaggatcatttgaacccaggaatttgaggctgtagtgagtcatgatcacgccattgcactccagcctgggcaacagagtgagaccctgaatatttaaaaacaacaacaacaa

SEQ ID NO: 359450 - DNA, 1572 bp, Homo sapiens
aaaaaggcgcgcggaaggggtcctgccaccgcgccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcg

SEQ ID NO: 359451 - DNA, 1560 bp, Homo sapiens
cgcgggacggccgcgggaaaaggcgcgcggaaggggtcctgccaccgcgccacttgacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcg

SEQ ID NO: 359452 - DNA, 1299 bp, Homo sapiens
gggaacttgaccagaatttgtcaagatgtttcaaatttcatgaaaaatgccaaaaatgtcaggctcacctatctgaagactgtcctgatgtacctgctctgcacacagaattagacgaggcgatcaggttggtcaatgtatccaatcagcagtatggccagattctccagatgacccggaagcacttggaggacaccgcctatctggtggagaagatgagagggcaatttggctgggtgtctgaactggcaaaccaggccccagaaacagagatcatctttaattcaatacaggtagttccaaggattcatgaaggaaatatttccaaacaagatgaaacaatgatgacagacttaagcattctgccttcctctaatttcacactcaagatccctcttgaagaaagtgctgagagttctaacttcattggctacgtagtggcaaaagctctacagcattttaaggaacattttaaaacctggtaagaagatctaatgcatcctatatccagtaagtagaattatctcttcatctgggacctggaaatcctgaaataaaaaaggataatgcaataaacacagttgcaggaaagtatgttagctatatactatgaagtactcttagtttacttatgttgaatggcttagctattaatactcaaattgagttaaaatgaaaattcctccttaaaaaatcaaacgtaatatgtattacatttcatggtacattagtagttctttgtatattgaataaatactaaatcacctaggtgtctatgttctatcacatctacaaacatgtcacttcctaattaacaaaatgttcttcctttagtttgcttttgcacttaaaatatatataattgacttttttggaaaaaaatctaagattcattgctttgttttgtaaagaccaataggttctgtatagtctttttttaaattgtggtaaaatacacatggcattaatttaccattttaaccattttaaagtgcacaatttgtggcattaagtacactcacgttgctgtgcaaccatcaccaccgtccatcttcagaacctttttatcttcctaaactgaaactctgtactcgttaagcactcacttcccttttccccatcccccagcccgtagcaaccacgactgtactttctatgaatttgactactctaggtactgcatgtaggtggaatcatacagtatttgtcttttgctttgttttgttttgttttttgttttctaagacagggtctcactctgtcgcccaggctggagtgcagtggtgcaatcacagtgtc

SEQ ID NO: 359453 - DNA, 2145 bp, Homo sapiens
  misc_feature (28)..(28): n is a, c, g, or t
tggctagtacgaggctcggttaatcggncgagggtctgccaccgctccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359454 - DNA, 2128 bp, Homo sapiens
ccccccccacccccccctccccaccctcgcccgccacctaggcttaggtacgagctgggtttaaacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359455 - DNA, 1390 bp, Homo sapiens
cgcgggacggccgcgggaaaaggcgcgcggaaggggtcctgccaccgcgccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctttagctgattcctgagggtggtatgacttctagctgaactcatcttgatcggtaggattttttaaatccatttttgtaaaactatttccaagaaattttaagccctttcacttcagaaagaaaaaagttgttggggctgagcacttaattttcttgagcaggaaggagtttcttccaaacttcaccatctggatactggtgtttctttacagattcctccttc

SEQ ID NO: 359456 - DNA, 1778 bp, Homo sapiens
caaaaaaaacagaacggaaagaacaataggctagtacagctgcttatcggcagaggagggctcatgatgctatgagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359457 - DNA, 1672 bp, Homo sapiens
ggtcccaccaagacctggagctcaacaagcagaagcagggcagaagcaggaagcagggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359458 - DNA, 1854 bp, Homo sapiens
cgcgggacggccgcgggaaaaggcgcgcggaaggggtcctgccaccgcgccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcaggtaagaattagatgttatacttttgggtttggtaccttctcttgataaaaggttgactgtggaacaggcatctgctcaatgctgtgtccaagataaagatgactgctccaaatgtggggcttcagtttagggagaagtggtgggcaggtgggcaggacaaggcaggcatctgcctcagcaaccatgggcacttaacatgtcaggtgctgtgaggtactaagcaccagtaccagagagggaagagccacattcaagccaggggattgtccaaaagggggcattttaactcattttaacttgaaggagaattgaagtgcaaatgtttttccttttcttttttttttgagatggagtctttctctgtcggccaggctggagtgtgccgtggtgcgatctcagctcactgcaacctccacctcccgggttcaagcaattcttctgcctcagcctcccaggtagctgggattacaggcacatgccaccacacccagctaatttttgtattattagtagagatggggtttcgtcatgttggccaggctagtctcaaactcctgacttcaagtgatccacctgcctcagcctccgaaagttctggaattacaggcataagccaccaccctggccataaatattttttgttaattttacattaagtacaatatttaggtccaaacttcaaaagtctgttgaaatccctaagttatagcagccaacaattgatatgaaatggcaataaaaatgtaagttcatctgcttcatgagccttaaggaaaaaaactcagaaccagacactttttagccccttccaggttagatccaggttttaaaagttactcctttgagggagtttggctgcttttgagtggaggtgacttcaggcttattctctctggctctctgc

SEQ ID NO: 359459 - DNA, 2366 bp, Homo sapiens
cgcgggacggccgcgggaaaaggcgcgcggaaggggtcctgccaccgcgccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaaggtgggctgtctcgggaagggtgacttgccagcctaccacactgagctcttcagttctttaatatgggaaaacaaattgcagagtttagtctctgattagcttttaaatttgatatgtgtaagtaagaaatgaaccagcttttactttgaaaccttcctcttctggaaggttttctggccctgtggtatacgcactaacagatctatacaggttgtttgtgatacagcttctatggattttctcaaaagctatgctgaggttgggtatggtggctcatgcctgtaatcccagcactttgggagactgagacaggagcaattgcttgaggtctggagttcaataccagcctgggcaacataacaagatgctgttgctacaaaaaaatggaaaagctacactaaattatttttttaaaaaaagccttgcggtgtctgcatattctaatgtttttaaatgatgttttaaagaattgaaactaacatactgttctgctttctcccccgggtttatagccaggtgactttatacacactttgggagatgcacatatttacctgaatcacatcgagccactgaaaattcaggtaagaattagatgttatacttttgggtttggtaccttctcttgataaaaggttgactgtggaacaggcatctgctcaatgctgtgtccaagataaagatgactgctccaaatgtggggcttcagtttagggagaagtggtgggcaggtgggcaggacaaggcaggcatctgcctcagcaaccatgggcacttaacatgtcaggtgctgtgaggtactaagcaccagtaccagagagggaagagccacattcaagccaggggattgtccaaaagggggcattttaactcattttaacttgaaggagaattgaagtgcaaatgtttttccttttcttttttttttgagatggagtctttctctgtcggccaggctggagtgtgccgtggtgcgatctcagctcactgcaacctccacctcccgggttcaagcaattcttctgcctcagcctcccaggtagctgggattacaggcacatgccaccacacccagctaatttttgtattattagtagagatggggtttcgtcatgttggccaggctagtctcaaactcctgacttcaagtgatccacctgcctcagcctccgaaagttctggaattacaggcataagccaccaccctggccataaatattttttgttaattttacattaagtacaatatttaggtccaaacttcaaaagtctgttgaaatccctaagttatagcagccaacaattgatatgaaatggcaataaaaatgtaagttcatctgcttcatgagccttaaggaaaaaaactcagaaccagacactttttagccccttccaggttagatccaggttttaaaagttactcctttgagggagtttggctgcttttgagtggaggtgacttcaggcttattctctctggctctctgc

SEQ ID NO: 359460 - DNA, 1184 bp, Homo sapiens
cgcgggacggccgcgggaaaaggcgcgcggaaggggtcctgccaccgcgccacttggcctgcctccgtcccgccgcgccacttcacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaaggtgggctgtctcgggaagggtgacttgccagcctaccacactgagctcttcagttctttaatatgggaaaacaaattgcagagtttagtctctgattagcttttaaatttgatatgtgtaagtaagaaatgaaccagcttttactttgaaaccttcctcttctggaaggttttctggccctgtggtatacgcactaacagatctatacaggttgtttgtgatacagcttctatggattttctcaaaagctatgctgaggttgggtatggtggctgtagttactgtgttcagggtgaataagctttt

SEQ ID NO: 359461 - DNA, 1896 bp, Homo sapiens
tgaaaccgtatggcaaattgtttttcatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatggcaggacagctcactgttcaccacatagaactggcagagggcatggcagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359462 - DNA, 1672 bp, Homo sapiens
attggcacttactgggcgcttggcactttccatactgtgtcatcggcagatagctgcatggttggtgttcgtgctggggaatgggaagttcatcggtgggacaagggacaaaatgcccccattgctttgttgtggctttaatctccctttcgaggctgagccacagcgtgctgtaggtggcgctgctgtgaagcgcagtgccagggtcacactccactcccagctcctgatgaggcaccaggctcctgatgctgtgtaatgtcacaaaatacccctcactctcgatctgtgcaagagaacagctggttgcgctccaatcatgttacataacctacggcaaggtatcgacaggatcatactcctgtaaaatagaactttgttgatcacatcctgtgtacttgtttcacggacatgaggagcaattacaacaggtcgtacaattatggcaaaataatggccttattttgtttttagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaacatgtgctgtattctggtttggatgctacttaaaagagtatattttagaaataatagtgaatatattttgccctatttttctcattttaactgcatcttatcctcaaaatataatgaccatttaggatagagtttttttttttttttttttaaacttttataaccttaaagggttattttaaaataatctatggactaccattttgccctcattagcttcagcatggtgtgacttctctaataatatgcttagattaagcaaggaaaagatgcaaaaccacttcggggttaatcagtgaaatatttttcccttcgttgcataccagatacccccggtgttgcacgactatttttattctgctaatttatgacaagtgttaaacagaacaaggaattattccaacaagttatgcaacatgttgcttattttcaaattacagtttaatgtctaggtgccagcccttgatatagctattttt

SEQ ID NO: 359463 - DNA, 1668 bp, Homo sapiens
cttctgcctgtactgctgctgctgctgctcagggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctatgccccgtggtgtgggcactgccaggccctggcccccgagtacagcaaggcagctgccgtgctcgcggccgagtcaatggtggtcacgctggccaaggtggatgggcccgcgcagcgcgagctggctgaggagtttggtgtgacggagtaccctacgctcaagttcttccgcaatgggaaccgcacgcacccggaggagtacacaggaccacgggacgctgagggcattgccgagtggctgcgacggcgggtggggcccagtgccatgcggctggaggacgaggcggccgcccaggcgctgatcggtggccgggacctagtggtcattggcttcttccaggacctgcaggacgaggacgtggccaccttcttggccttggcccaggacgccctggacatgacctttggcctcacagaccggccgcggctctttcagcagtttggcctcaccaaggacactgtggttctcttcaagaagtttgatgaggggcgggcagacttccccgtggacgaggagcttggcctggacctgggggatctgtcgcgcttcctggtcacacacagcatgcgcctggtcacggagttcaacagccagacgtctgccaagatcttcgcggccaggatcctcaaccacctgctgctgtttgtcaaccagacgctggctgcgcaccgggagctcctagcgggctttggggaggcagctccccgcttccgggggcaggtgctgttcgtggtggtggacgtggcggccgacaatgagcacgtgctgcagtactttggactcaaggctgaggcagcccccactctgcgcttggtcaaccttgaaaccactaagaagtatgcgcctgtggatgggggccctgtcaccgcagcgtccatcactgctttctgccatgcagtcctcaacggccaagtcaagccctatctcctgagccaggagataccccctgattgggatcagcggccagttaagaccctcgtgggcaagaattttgagcaggtggcttttgacgaaaccaagaatgtgtttgtcaagttctatgccccgtggtgcacccactgcaaggagatggcccctgcctgggaggcattggctgagaagtaccaagaccacgaggacatcatcattgctgagctggatgccacggccaacgagctggatgccttcgctgtgcacggcttccctactctcaagtacttcccagcagggccaggtcggaaggtgattgaatacaaaagcaccagggacctggagactttctccaagttcctggacaacgggggcgtgctgcccacggaggagcccccggaggagccagcagccccgttcccggagccaccggccaactccactatggggtccaaggaggaactgtagctgcccccgtgtcacccccgccatcactgctggacaggagccacccccttgggtaccagagggagctgtgcattgtgaataaagagtgagcttggttctgga

SEQ ID NO: 359464 - DNA, 2157 bp, Homo sapiens
cttctgcctgtactgctgctgctgctgctcagggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctatgccccgtggtgtgggcactgccaggccctggcccccgagtacagcaaggcagctgccgtgctcgcggccgagtcaatggtggtcacgctggccaaggtggatgggcccgcgcagcgcgagctggctgaggagtttggtgtgacggagtaccctacgctcaagttcttccgcaatgggaaccgcacgcacccggaggagtacacaggaccacgggacgctgagggcattgccgagtggctgcgacggcgggtggggcccagtgccatgcggctggaggacgaggcggccgcccaggcgctgatcggtggccgggacctagtggtcattggcttcttccaggacctgcaggacgaggacgtggccaccttcttggccttggcccaggacgccctggacatgacctttggcctcacagaccggccgcggctctttcagcagtttggcctcaccaaggacactgtggttctcttcaagaaggtaggtcaggcccaggtgtgggttggggtccggctgcagcgcccgctaacccacctgctgctgtccagtttgatgaggggcgggcagacttccccgtggacgaggagcttggcctggacctgggggatctgtcgcgcttcctggtcacacacagcatgcgcctggtcacggagttcaacagccaggtgcgtaggctgcagtgcctgggctgggggtgtcccagggtagagtcgtccagggatgggggtgcctaggctgggggtcctgtggagtcatgagcaccctccctactgtagacgtctgccaagatcttcgcggccaggatcctcaaccacctgctgctgtttgtcaaccagacgctggctgcgcaccgggagctcctagcgggctttggggaggcagctccccgcttccgggggcaggtactggggggctgggggaaaggggcagcgggagagtggccggtgccagcatggactccctgccacaggtgctgttcgtggtggtggacgtggcggccgacaatgagcacgtgctgcagtactttggactcaaggctgaggcagcccccactctgcgcttggtcaaccttgaaaccactaagaagtatgcgcctgtggatgggggccctgtcaccgcagcgtccatcactgctttctgccatgcagtcctcaacggccaagtcaagccctatctcctgagccaggagataccccctgattgggatcagcggccagttaagaccctcgtgggcaagaattttgagcaggtggcttttgacgaaaccaagaatgtgtttgtcaagttctatgccccgtggtgcacccactgcaaggagatggcccctgcctgggaggcattggctgagaagtaccaagaccacgaggacatcatcattgctgagctggatgccacggccaacgagctggatgccttcgctgtgcacggcttccctactctcaagtacttcccagcagggccaggtcggaaggtgattgaatacaaaagcaccagggacctggagactttctccaagttcctggacaacgggggcgtgctgcccacggaggagcccccggaggagccagcagccccgttcccggagccaccggccaactccactatggggtccaaggaggaactgtagctgcccccgtgtcacccccgccatcactgctggacaggagccacccccttgggtaccagagggagctgtgcattgtgaataaagagtgagcttggttctggaaaaaaaaaaaacaaacaaaaaaaaaaaaacacaaagaacatgaaaaaacacaacaaaggaacaaacgccgcggaacgaataaagagaggggaggcgaaaaaagaacgagacacagaagcgggcaccagcacacagagaaagatgaacacagaggcaatgtagcgacaacgagggcggataccaacaggcggaaaccacaaaaaaggagagaagaaataatgaacggagacaagggagccaac

SEQ ID NO: 359465 - DNA, 1963 bp, Homo sapiens
gccactgagcctggctgtggggggagggggggtggtctttcaagctctcccaagccttactggtccctgtgctgcagcctggggggccacgaagaggcactggtgctcggcttgtccacggccagggctcagggcagaatggagcagcacgcttgttccctgctgggttgtcaggtgtggagagggtgctcctggggttgtggtggcctggggcactcacggccccatcccccagatgccccgtggtgtgggcactgccaggccctggcccccgagtacagcaaggcagctgccgtgctcgcggccgagtcaatggtggtcacgctggccaaggtggatgggcccgcgcagcgcgagctggctgaggagtttggtgtgacggagtaccctacgctcaagttcttccgcaatgggaaccgcacgcacccggaggagtacacaggaccacgggacgctgagggcattgccgagtggctgcgacggcgggtggggcccagtgccatgcggctggaggacgaggcggccgcccaggcgctgatcggtggccgggacctagtggtcattggcttcttccaggacctgcaggacgaggacgtggccaccttcttggccttggcccaggacgccctggacatgacctttggcctcacagaccggccgcggctctttcagcagtttggcctcaccaaggacactgtggttctcttcaagaaggtaggtcaggcccaggtgtgggttggggtccggctgcagcgcccgctaacccacctgctgctgtccagtttgatgaggggcgggcagacttccccgtggacgaggagcttggcctggacctgggggatctgtcgcgcttcctggtcacacacagcatgcgcctggtcacggagttcaacagccaggtgcgtaggctgcagtgcctgggctgggggtgtcccagggtagagtcgtccagggatgggggtgcctaggctgggggtcctgtggagtcatgagcaccctccctactgtagacgtctgccaagatcttcgcggccaggatcctcaaccacctgctgctgtttgtcaaccagacgctggctgcgcaccgggagctcctagcgggctttggggaggcagctccccgcttccgggggcaggtactggggggctgggggaaaggggcagcgggagagtggccggtgccagcatggactccctgccacaggtgctgttcgtggtggtggacgtggcggccgacaatgagcacgtgctgcagtactttggactcaaggctgaggcagcccccactctgcgcttggtcaaccttgaaaccactaagaagtatgcgcctgtggatgggggccctgtcaccgcagcgtccatcactgctttctgccatgcagtcctcaacggccaagtcaagccctatctcctgagccaggagataccccctgattgggatcagcggccagttaagaccctcgtgggcaagaattttgagcaggtggcttttgacgaaaccaagaatgtgtttgtcaagttctatgccccgtggtgcacccactgcaaggagatggcccctgcctgggaggcattggctgagaagtaccaagaccacgaggacatcatcattgctgagctggatgccacggccaacgagctggatgccttcgctgtgcacggcttccctactctcaagtacttcccagcagggccaggtcggaaggtgattgaatacaaaagcaccagggacctggagactttctccaagttcctggacaacgggggcgtgctgcccacggaggagcccccggaggagccagcagccccgttcccggagccaccggccaactccactatggggtccaaggaggaactgtagctgcccccgtgtcacccccgccatcactgctggacaggagccacccccttgggtaccagagggagctgtgcattgtgaataaagagtgagcttggttctgga

SEQ ID NO: 359466 - DNA, 1802 bp, Homo sapiens
cttctgcctgtactgctgctgctgctgctcagggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctatgccccgtggtgtgggcactgccaggccctggcccccgagtacagcaaggcagctgccgtgctcgcggccgagtcaatggtggtcacgctggccaaggtggatgggcccgcgcagcgcgagctggctgaggagtttggtgtgacggagtaccctacgctcaagttcttccgcaatgggaaccgcacgcacccggaggagtacacaggaccacgggacgctgagggcattgccgagtggctgcgacggcgggtggggcccagtgccatgcggctggaggacgaggcggccgcccaggcgctgatcggtggccgggacctagtggtcattggcttcttccaggacgccctggacatgacctttggcctcacagaccggccgcggctctttcagcagtttggcctcaccaaggacactgtggttctcttcaagaagtttgatgaggggcgggcagacttccccgtggacgaggagcttggcctggacctgggggatctgtcgcgcttcctggtcacacacagcatgcgcctggtcacggagttcaacagccaggtgcgtaggctgcagtgcctgggctgggggtgtcccagggtagagtcgtccagggatgggggtgcctaggctgggggtcctgtggagtcatgagcaccctccctactgtagacgtctgccaagatcttcgcggccaggatcctcaaccacctgctgctgtttgtcaaccagacgctggctgcgcaccgggagctcctagcgggctttggggaggcagctccccgcttccgggggcaggtactggggggctgggggaaaggggcagcgggagagtggccggtgccagcatggactccctgccacaggtgctgttcgtggtggtggacgtggcggccgacaatgagcacgtgctgcagtactttggactcaaggctgaggcagcccccactctgcgcttggtcaaccttgaaaccactaagaagtatgcgcctgtggatgggggccctgtcaccgcagcgtccatcactgctttctgccatgcagtcctcaacggccaagtcaagccctatctcctgagccaggagataccccctgattgggatcagcggccagttaagaccctcgtgggcaagaattttgagcaggtggcttttgacgaaaccaagaatgtgtttgtcaagttctatgccccgtggtgcacccactgcaaggagatggcccctgcctgggaggcattggctgagaagtaccaagaccacgaggacatcatcattgctgagctggatgccacggccaacgagctggatgccttcgctgtgcacggcttccctactctcaagtacttcccagcagggccaggtcggaaggtgattgaatacaaaagcaccagggacctggagactttctccaagttcctggacaacgggggcgtgctgcccacggaggagcccccggaggagccagcagccccgttcccggagccaccggccaactccactatggggtccaaggaggaactgtagctgcccccgtgtcacccccgccatcactgctggacaggagccacccccttgggtaccagagggagctgtgcattgtgaataaagagtgagcttggttctgga

SEQ ID NO: 359467 - DNA, 2443 bp, Homo sapiens
cagcgctgagctgcaggcgcggcgaaacttccctctacccgcccggcccgcggcgcgcaccgttggcgctggacgcttcctccttggaagcgcctctccctcagttatggagaaaacttgtatagatgcacttcctcttactatgaattcttcagaaaagcaagagactgtatgtatttttggaactggtgattttggaagatcactgggattgaaaatgctccagtgtggttattctgttgtttttggaagtcgaaacccccagaagaccaccctactgcccagtggtgcagaagtcttgagctattcagaagcagccaagaagtctgacatcataatcatagcaatccacagagagcattatgattttctcacagaattaactgaggttctcaatggaaaaatattggtagacatcagcaacaacctcaaaatcaatcaatatccagaatctaatgcagagtaccttgctcatttggtgccaggagcccacgtggtaaaagcatttaacaccatctcagcctgggctctccagtcaggagcactggatgcaagtcggcaggtgtttgtgtgtggaaatgacagcaaagccaagcaaagagtgatggatattgttcgtaatcttggacttactccaatggatcaaggatcactcatggcagccaaagaaattgaaaagtaccccctgcagctatttccaatgtggaggttccccttctatttgtctgctgtgctgtgtgtcttcttgtttttctattgtgttataagagacgtaatctacccttatgtttatgaaaagaaagataatacatttcgtatggctatttccattccaaatcgtatctttccaataacagcaccttacactgcttgctttggtttacctccctggtgttattgctgccattctacaactgtaccgaggcacaaaataccgtcgattcccagactggcttgaccactggatgctttgccgaaagcagcttggcttggtagctctgggatttgccttccttcatgtcctctacacacttgtgattcctattcgatattatgtacgatggagattgggaaacttaaccgttacccaggcaatactcaagaaggagaatccatttagcacctcctcagcctggctcagtgattcatatgtggctttgggaatacttgggttttttctgtttgtactcttggggaatcacttctttgccatctgttagcaatgcagtcaactggagagagttccgatttgtccagtccaaactgggttatttgaccctgatcttgtgtacagcccacaccctggtgtacggtgggaagagattcctcagcccttcaaatctcagatggtatcttcctgcagcctacgtgttagggcttatcattccttgcactgtgctggtgatcaagtttgtcctaatcatgccatgtgtagacaacacccttacaaggatccgccagggctgggaaaggaactcaaaacactagaaaaagcattgaatggaaaatcaatatttaaaacaaagttcaatttagctggatttctgaactatggttttgaatgtttaaagaagaatgatgggtacagttaggaaagtttttttcttacaccgtgactgagggaaacattgcttgtctttgagaaattgactgacatactggaagagaacaccattttatctcaggttagtgaagaatcagtgcaggtccctgactcttattttcccagaggccatggagctgagattgagactagccttgtggtttcacactaaagagtttccttgttatgggcaacatgcatgacctaatgtcttgcaaaatccaatagaagtattgcagcttccttctctggctcaagggctgagttaagtgaaaggaaaaacagcacaatggtgaccactgataaaggctttattaggtatatctgaggaagtgggtcacatgaaatgtaaaaagggaatgaggtttttgttgttttttggaagtaaaggcaaacataaatattaccatgatgaattctagtgaaatgaccccttgactttgcttttcttaatacagatatttactgagaggaactatttttataacacaagaaaaatttacaattgattaaaagtatccatgtcttggatacatacgtatctatagagctggcatgtaattcttcctctataaagaataggtataggaaagactgaataaaaatggagggatatccccttggatttcacttgcattgtgcaataagcaaagaagggttgataaaagttcttgatcaaaaagttcaaagaaaccagaattttagacagcaagctaaataaatattgtaaaattgcactatattaggttaagtattatttaggtattataatatgctttgtaaattttatattccaaatattgctcaatatttttcatctattaaattaatttctagtgt

SEQ ID NO: 359468 - DNA, 3928 bp, Homo sapiens
  misc_feature (2432)..(2432): n is a, c, g, or t
cagcgctgagctgcaggcgcggcgaaacttccctctacccgcccggcccgcggcgcgcaccgttggcgctggacgcttcctccttggaagcgcctctccctcagttatggagaaaacttgtatagatgcacttcctcttactatgaattcttcagaaaagcaagagactgtatgtatttttggaactggtgattttggaagatcactgggattgaaaatgctccagtgtggttattctgttgtttttggaagtcgaaacccccagaagaccaccctactgcccagtggtgcagaagtcttgagctattcagaagcagccaagaagtctgacatcataatcatagcaatccacagagagcattatgattttctcacagaattaactgaggttctcaatggaaaaatattggtagacatcagcaacaacctcaaaatcaatcaatatccagaatctaatgcagagtaccttgctcatttggtgccaggagcccacgtggtaaaagcatttaacaccatctcagcctgggctctccagtcaggagcactggatgcaagtcggcaggcaatactcaagaaggagaatccatttagcacctcctcagcctggctcagtgattcatatgtggctttgggaatacttgggttttttctgtttgtactcttggggaatcacttctttgccatctgttagcaatgcagtcaactggagagagttccgatttgtccagtccaaactgggttatttgaccctgatcttgtgtacagcccacaccctggtgtacggtgggaagagattcctcagcccttcaaatctcagatggtatcttcctgcagcctacgtgttagggcttatcattccttgcactgtgctggtgatcaagtttgtcctaatcatgccatgtgtagacaacacccttacaaggatccgccagggctgggaaaggaactcaaaacactagaaaaagcattgaatggaaaatcaatatttaaaacaaagttcaatttagctggatttctgaactatggttttgaatgtttaaagaagaatgatgggtacagttaggaaagtttttttcttacaccgtgactgagggaaacattgcttgtctttgagaaattgactgacatactggaagagaacaccattttatctcaggttagtgaagaatcagtgcaggtccctgactcttattttcccagaggccatggagctgagattgagactagccttgtggtttcacactaaagagtttccttgttatgggcaacatgcatgacctaatgtcttgcaaaatccaatagaagtattgcagcttccttctctggctcaagggctgagttaagtgaaaggaaaaacagcacaatggtgaccactgataaaggctttattaggtatatctgaggaagtgggtcacatgaaatgtaaaaagggaatgaggtttttgttgttttttggaagtaaaggcaaacataaatattaccatgatgaattctagtgaaatgaccccttgactttgcttttcttaatacagatatttactgagaggaactatttttataacacaagaaaaatttacaattgattaaaagtatccatgtcttggatacatacgtatctatagagctggcatgtaattcttcctctataaagaataggtataggaaagactgaataaaaatggagggatatccccttggatttcacttgcattgtgcaataagcaaagaagggttgataaaagttcttgatcaaaaagttcaaagaaaccagaattttagacagcaagctaaataaatattgtaaaattgcactatattaggttaagtattatttaggtattataatatgctttgtaaattttatattccaaatattgctcaatatttttcatctattaaattaatttctagtgtaaataagtagcttctatatctgtcttagtctattataattgtaaggagtaaaattaaatgaatagtctgcaggtataaatttgaacaatgcatagatgatcgaaaattacggaaaatcatagggcagagaggtgtgaagattcatcattatgtgaaatttggatctttctcaaatccttgctgaaatttaggatggttctcactgtttttctgtgctgatagtaccctttccaaggtgaccttcagggggattaaccttcctagctcaagcaatgagctaaaaggagccttatgcatgatcttcccacatatcaaaataactaaaaggcactgagtttggcatttttctgcctgctctgctaagacctttttttttttttactttcattataacatattatacatgacattatacaaaaatgattaaaatatattaaaacaacatcaacaatccaggatatttttctataaaactttttaaaaataattgtatctatatattcaattttacatccttnttcaaaggctttgtttttctaaaggctttgttttcctttttattatttttttcttttttatttttttgagacagtcttgctctgtcgctcaggctggagtgcagtggcacgatctcagctcactgcaacctcctcctcccaggttcaagtgattcttgttcatcagcctcccgagtagctgggactacaggcatgtgccactatgcccagctaatttttgtacttttagtagagacagggtttcaccacattggtcaggctggtcttgaaatgctggcgtcaagtgatctgcctgcctccgcctcacaaagcactgggattacaggcatgaatctggccttacgtaatatattttcttaatggctgcataatatcacatcaaataggcatttttcaaacctctttccttattaaacatgtagactatatccattttttactaaaataaataacatttcagataatatctttgcactgataatgttgccaagccatttctaaagtgaccttatcaatttaattaccattggatgagggtgttgctttcatcgcaccattgtagattgtcttttttatttcaatttgcgtttatttataactggttgcaaaggtacacagaacacacgctccttcaacttatctttgataaacccaagcaaggatacaaaaagttggacgacattgagtagagtcatggtatacggtgctgaccctacagtatcagtggaaaagataaggaaaatgtcactactcacctatgttatgcaaaacagttaggtgtgctggggctggatactgctcttttacttgagcattggttgattaaagtttaggtaccatccaggctggtctagagaagtctttggagttaaccatgctctttttgttaaagaagagagtaatgtgtttatcctggctcatagtccgtcaccgaaaatagaaaatgccatccataggtaaaatgctgacctatagaaaaaaatgaactctacttttatagcctagtaaaaatgctctacctgagtagttaaaagcaattcatgaagcctgaagctaaagagcactctgatggttttggcataatagctgcatttccagacctgacctttggccccaaccacaagtgctccaagccccaccagctgaccaaagaaagcccaagttctccttctgtccttcccacaacctccctgctcccaaaactatgaaattaatttgaccatattaacacagctgactcctccagtttacttaaggtagaaagaatgagtttacaacagatgaaaataagtgctttgggcgaactgtattccttttaacagatccaaactattttacatttaaaaaaaaagttaaactaaacttctttactgctgatatgtttcctgtattctagaaaaatttttacactttcacattatttttgtacactttccccatgttaagggatgatggcttttataaatgtgtattcattaaatgttactttaaaaata

SEQ ID NO: 359469 - DNA, 4480 bp, Homo sapiens
  misc_feature (3060)..(3060): n is a, c, g, or t
cagcgctgagctgcaggcgcggcgaaacttccctctacccgcccggcccgcggcgcgcaccgttggcgctggacgcttcctccttggaagcgcctctccctcaggtctcaagaactgttttgagatgcaggaattcatctaattttcactgccgggcgaggtgtgagagccctagcatctgaaagtggtcgacttgcgagttgttatggagaaaacttgtatagatgcacttcctcttactatgaattcttcagaaaagcaagagactgtatgtatttttggaactggtgattttggaagatcactgggattgaaaatgctccagtgtggttattctgttgtttttggaagtcgaaacccccagaagaccaccctactgcccagtggtgcagaagtcttgagctattcagaagcagccaagaagtctgacatcataatcatagcaatccacagagagcattatgattttctcacagaattaactgaggttctcaatggaaaaatattggtagacatcagcaacaacctcaaaatcaatcaatatccagaatctaatgcagagtaccttgctcatttggtgccaggagcccacgtggtaaaagcatttaacaccatctcagcctgggctctccagtcaggagcactggatgcaagtcggcaggtgtttgtgtgtggaaatgacagcaaagccaagcaaagagtgatggatattgttcgtaatcttggacttactccaatggatcaaggatcactcatggcagccaaagaaattgaaaagtaccccctgcagctatttccaatgtggaggttccccttctatttgtctgctgtgctgtgtgtcttcttgtttttctattgtgttataagagacgtaatctacccttatgtttatgaaaagaaagataatacatttcgtatggctatttccattccaaatcgtatctttccaataacagcaccttacactgcttgctttggtttacctccctggtgttattgctgccattctacaactgtaccgaggcacaaaataccgtcgattcccagactggcttgaccactggatgctttgccgaaagcagcttggcttggtagctctgggatttgccttccttcatgtcctctacacacttgtgattcctattcgatattatgtacgatggagattgggaaacttaaccgttacccaggcaatactcaagaaggagaatccatttagcacctcctcagcctggctcagtgattcatatgtggctttgggaatacttgggttttttctgtttgtactcttggggaatcacttctttgccatctgttagcaatgcagtcaactggagagagttccgatttgtccagtccaaactgggttatttgaccctgatcttgtgtacagcccacaccctggtgtacggtgggaagagattcctcagcccttcaaatctcagatggtatcttcctgcagcctacgtgttagggcttatcattccttgcactgtgctggtgatcaagtttgtcctaatcatgccatgtgtagacaacacccttacaaggatccgccagggctgggaaaggaactcaaaacactagaaaaagcattgaatggaaaatcaatatttaaaacaaagttcaatttagctggatttctgaactatggttttgaatgtttaaagaagaatgatgggtacagttaggaaagtttttttcttacaccgtgactgagggaaacattgcttgtctttgagaaattgactgacatactggaagagaacaccattttatctcaggttagtgaagaatcagtgcaggtccctgactcttattttcccagaggccatggagctgagattgagactagccttgtggtttcacactaaagagtttccttgttatgggcaacatgcatgacctaatgtcttgcaaaatccaatagaagtattgcagcttccttctctggctcaagggctgagttaagtgaaaggaaaaacagcacaatggtgaccactgataaaggctttattaggtatatctgaggaagtgggtcacatgaaatgtaaaaagggaatgaggtttttgttgttttttggaagtaaaggcaaacataaatattaccatgatgaattctagtgaaatgaccccttgactttgcttttcttaatacagatatttactgagaggaactatttttataacacaagaaaaatttacaattgattaaaagtatccatgtcttggatacatacgtatctatagagctggcatgtaattcttcctctataaagaataggtataggaaagactgaataaaaatggagggatatccccttggatttcacttgcattgtgcaataagcaaagaagggttgataaaagttcttgatcaaaaagttcaaagaaaccagaattttagacagcaagctaaataaatattgtaaaattgcactatattaggttaagtattatttaggtattataatatgctttgtaaattttatattccaaatattgctcaatatttttcatctattaaattaatttctagtgtaaataagtagcttctatatctgtcttagtctattataattgtaaggagtaaaattaaatgaatagtctgcaggtataaatttgaacaatgcatagatgatcgaaaattacggaaaatcatagggcagagaggtgtgaagattcatcattatgtgaaatttggatctttctcaaatccttgctgaaatttaggatggttctcactgtttttctgtgctgatagtaccctttccaaggtgaccttcagggggattaaccttcctagctcaagcaatgagctaaaaggagccttatgcatgatcttcccacatatcaaaataactaaaaggcactgagtttggcatttttctgcctgctctgctaagacctttttttttttttactttcattataacatattatacatgacattatacaaaaatgattaaaatatattaaaacaacatcaacaatccaggatatttttctataaaactttttaaaaataattgtatctatatattcaattttacatccttnttcaaaggctttgtttttctaaaggctttgttttcctttttattatttttttcttttttatttttttgagacagtcttgctctgtcgctcaggctggagtgcagtggcacgatctcagctcactgcaacctcctcctcccaggttcaagtgattcttgttcatcagcctcccgagtagctgggactacaggcatgtgccactatgcccagctaatttttgtacttttagtagagacagggtttcaccacattggtcaggctggtcttgaaatgctggcgtcaagtgatctgcctgcctccgcctcacaaagcactgggattacaggcatgaatctggccttacgtaatatattttcttaatggctgcataatatcacatcaaataggcatttttcaaacctctttccttattaaacatgtagactatatccattttttactaaaataaataacatttcagataatatctttgcactgataatgttgccaagccatttctaaagtgaccttatcaatttaattaccattggatgagggtgttgctttcatcgcaccattgtagattgtcttttttatttcaatttgcgtttatttataactggttgcaaaggtacacagaacacacgctccttcaacttatctttgataaacccaagcaaggatacaaaaagttggacgacattgagtagagtcatggtatacggtgctgaccctacagtatcagtggaaaagataaggaaaatgtcactactcacctatgttatgcaaaacagttaggtgtgctggggctggatactgctcttttatttgttaaagaagagagtaatgtgtttatcctggctcatagtccgtcaccgaaaatagaaaatgccatccataggtaaaatgctgacctatagaaaaaaatgaactctacttttatagcctagtaaaaatgctctacctgagtagttaaaagcaattcatgaagcctgaagctaaagagcactctgatggttttggcataatagctgcatttccagacctgacctttggccccaaccacaagtgctccaagccccaccagctgaccaaagaaagcccaagttctccttctgtccttcccacaacctccctgctcccaaaactatgaaattaatttgaccatattaacacagctgactcctccagtttacttaaggtagaaagaatgagtttacaacagatgaaaataagtgctttgggcgaactgtattccttttaacagatccaaactattttacatttaaaaaaaaagttaaactaaacttctttactgctgatatgtttcctgtattctagaaaaatttttacactttcacattatttttgtacactttccccatgttaagggatgatggcttttataaatgtgtattcattaaatgttactttaaaaata

SEQ ID NO: 359470 - DNA, 4556 bp, Homo sapiens
  misc_feature (3060)..(3060): n is a, c, g, or t
cagcgctgagctgcaggcgcggcgaaacttccctctacccgcccggcccgcggcgcgcaccgttggcgctggacgcttcctccttggaagcgcctctccctcaggtctcaagaactgttttgagatgcaggaattcatctaattttcactgccgggcgaggtgtgagagccctagcatctgaaagtggtcgacttgcgagttgttatggagaaaacttgtatagatgcacttcctcttactatgaattcttcagaaaagcaagagactgtatgtatttttggaactggtgattttggaagatcactgggattgaaaatgctccagtgtggttattctgttgtttttggaagtcgaaacccccagaagaccaccctactgcccagtggtgcagaagtcttgagctattcagaagcagccaagaagtctgacatcataatcatagcaatccacagagagcattatgattttctcacagaattaactgaggttctcaatggaaaaatattggtagacatcagcaacaacctcaaaatcaatcaatatccagaatctaatgcagagtaccttgctcatttggtgccaggagcccacgtggtaaaagcatttaacaccatctcagcctgggctctccagtcaggagcactggatgcaagtcggcaggtgtttgtgtgtggaaatgacagcaaagccaagcaaagagtgatggatattgttcgtaatcttggacttactccaatggatcaaggatcactcatggcagccaaagaaattgaaaagtaccccctgcagctatttccaatgtggaggttccccttctatttgtctgctgtgctgtgtgtcttcttgtttttctattgtgttataagagacgtaatctacccttatgtttatgaaaagaaagataatacatttcgtatggctatttccattccaaatcgtatctttccaataacagcaccttacactgcttgctttggtttacctccctggtgttattgctgccattctacaactgtaccgaggcacaaaataccgtcgattcccagactggcttgaccactggatgctttgccgaaagcagcttggcttggtagctctgggatttgccttccttcatgtcctctacacacttgtgattcctattcgatattatgtacgatggagattgggaaacttaaccgttacccaggcaatactcaagaaggagaatccatttagcacctcctcagcctggctcagtgattcatatgtggctttgggaatacttgggttttttctgtttgtactcttggggaatcacttctttgccatctgttagcaatgcagtcaactggagagagttccgatttgtccagtccaaactgggttatttgaccctgatcttgtgtacagcccacaccctggtgtacggtgggaagagattcctcagcccttcaaatctcagatggtatcttcctgcagcctacgtgttagggcttatcattccttgcactgtgctggtgatcaagtttgtcctaatcatgccatgtgtagacaacacccttacaaggatccgccagggctgggaaaggaactcaaaacactagaaaaagcattgaatggaaaatcaatatttaaaacaaagttcaatttagctggatttctgaactatggttttgaatgtttaaagaagaatgatgggtacagttaggaaagtttttttcttacaccgtgactgagggaaacattgcttgtctttgagaaattgactgacatactggaagagaacaccattttatctcaggttagtgaagaatcagtgcaggtccctgactcttattttcccagaggccatggagctgagattgagactagccttgtggtttcacactaaagagtttccttgttatgggcaacatgcatgacctaatgtcttgcaaaatccaatagaagtattgcagcttccttctctggctcaagggctgagttaagtgaaaggaaaaacagcacaatggtgaccactgataaaggctttattaggtatatctgaggaagtgggtcacatgaaatgtaaaaagggaatgaggtttttgttgttttttggaagtaaaggcaaacataaatattaccatgatgaattctagtgaaatgaccccttgactttgcttttcttaatacagatatttactgagaggaactatttttataacacaagaaaaatttacaattgattaaaagtatccatgtcttggatacatacgtatctatagagctggcatgtaattcttcctctataaagaataggtataggaaagactgaataaaaatggagggatatccccttggatttcacttgcattgtgcaataagcaaagaagggttgataaaagttcttgatcaaaaagttcaaagaaaccagaattttagacagcaagctaaataaatattgtaaaattgcactatattaggttaagtattatttaggtattataatatgctttgtaaattttatattccaaatattgctcaatatttttcatctattaaattaatttctagtgtaaataagtagcttctatatctgtcttagtctattataattgtaaggagtaaaattaaatgaatagtctgcaggtataaatttgaacaatgcatagatgatcgaaaattacggaaaatcatagggcagagaggtgtgaagattcatcattatgtgaaatttggatctttctcaaatccttgctgaaatttaggatggttctcactgtttttctgtgctgatagtaccctttccaaggtgaccttcagggggattaaccttcctagctcaagcaatgagctaaaaggagccttatgcatgatcttcccacatatcaaaataactaaaaggcactgagtttggcatttttctgcctgctctgctaagacctttttttttttttactttcattataacatattatacatgacattatacaaaaatgattaaaatatattaaaacaacatcaacaatccaggatatttttctataaaactttttaaaaataattgtatctatatattcaattttacatccttnttcaaaggctttgtttttctaaaggctttgttttcctttttattatttttttcttttttatttttttgagacagtcttgctctgtcgctcaggctggagtgcagtggcacgatctcagctcactgcaacctcctcctcccaggttcaagtgattcttgttcatcagcctcccgagtagctgggactacaggcatgtgccactatgcccagctaatttttgtacttttagtagagacagggtttcaccacattggtcaggctggtcttgaaatgctggcgtcaagtgatctgcctgcctccgcctcacaaagcactgggattacaggcatgaatctggccttacgtaatatattttcttaatggctgcataatatcacatcaaataggcatttttcaaacctctttccttattaaacatgtagactatatccattttttactaaaataaataacatttcagataatatctttgcactgataatgttgccaagccatttctaaagtgaccttatcaatttaattaccattggatgagggtgttgctttcatcgcaccattgtagattgtcttttttatttcaatttgcgtttatttataactggttgcaaaggtacacagaacacacgctccttcaacttatctttgataaacccaagcaaggatacaaaaagttggacgacattgagtagagtcatggtatacggtgctgaccctacagtatcagtggaaaagataaggaaaatgtcactactcacctatgttatgcaaaacagttaggtgtgctggggctggatactgctcttttacttgagcattggttgattaaagtttaggtaccatccaggctggtctagagaagtctttggagttaaccatgctctttttgttaaagaagagagtaatgtgtttatcctggctcatagtccgtcaccgaaaatagaaaatgccatccataggtaaaatgctgacctatagaaaaaaatgaactctacttttatagcctagtaaaaatgctctacctgagtagttaaaagcaattcatgaagcctgaagctaaagagcactctgatggttttggcataatagctgcatttccagacctgacctttggccccaaccacaagtgctccaagccccaccagctgaccaaagaaagcccaagttctccttctgtccttcccacaacctccctgctcccaaaactatgaaattaatttgaccatattaacacagctgactcctccagtttacttaaggtagaaagaatgagtttacaacagatgaaaataagtgctttgggcgaactgtattccttttaacagatccaaactattttacatttaaaaaaaaagttaaactaaacttctttactgctgatatgtttcctgtattctagaaaaatttttacactttcacattatttttgtacactttccccatgttaagggatgatggcttttataaatgtgtattcattaaatgttactttaaaaata

SEQ ID NO: 359471 - DNA, 4818 bp, Homo sapiens
  misc_feature (3060)..(3060): n is a, c, g, or t
cagcgctgagctgcaggcgcggcgaaacttccctctacccgcccggcccgcggcgcgcaccgttggcgctggacgcttcctccttggaagcgcctctccctcaggtctcaagaactgttttgagatgcaggaattcatctaattttcactgccgggcgaggtgtgagagccctagcatctgaaagtggtcgacttgcgagttgttatggagaaaacttgtatagatgcacttcctcttactatgaattcttcagaaaagcaagagactgtatgtatttttggaactggtgattttggaagatcactgggattgaaaatgctccagtgtggttattctgttgtttttggaagtcgaaacccccagaagaccaccctactgcccagtggtgcagaagtcttgagctattcagaagcagccaagaagtctgacatcataatcatagcaatccacagagagcattatgattttctcacagaattaactgaggttctcaatggaaaaatattggtagacatcagcaacaacctcaaaatcaatcaatatccagaatctaatgcagagtaccttgctcatttggtgccaggagcccacgtggtaaaagcatttaacaccatctcagcctgggctctccagtcaggagcactggatgcaagtcggcaggtgtttgtgtgtggaaatgacagcaaagccaagcaaagagtgatggatattgttcgtaatcttggacttactccaatggatcaaggatcactcatggcagccaaagaaattgaaaagtaccccctgcagctatttccaatgtggaggttccccttctatttgtctgctgtgctgtgtgtcttcttgtttttctattgtgttataagagacgtaatctacccttatgtttatgaaaagaaagataatacatttcgtatggctatttccattccaaatcgtatctttccaataacagcaccttacactgcttgctttggtttacctccctggtgttattgctgccattctacaactgtaccgaggcacaaaataccgtcgattcccagactggcttgaccactggatgctttgccgaaagcagcttggcttggtagctctgggatttgccttccttcatgtcctctacacacttgtgattcctattcgatattatgtacgatggagattgggaaacttaaccgttacccaggcaatactcaagaaggagaatccatttagcacctcctcagcctggctcagtgattcatatgtggctttgggaatacttgggttttttctgtttgtactcttggggaatcacttctttgccatctgttagcaatgcagtcaactggagagagttccgatttgtccagtccaaactgggttatttgaccctgatcttgtgtacagcccacaccctggtgtacggtgggaagagattcctcagcccttcaaatctcagatggtatcttcctgcagcctacgtgttagggcttatcattccttgcactgtgctggtgatcaagtttgtcctaatcatgccatgtgtagacaacacccttacaaggatccgccagggctgggaaaggaactcaaaacactagaaaaagcattgaatggaaaatcaatatttaaaacaaagttcaatttagctggatttctgaactatggttttgaatgtttaaagaagaatgatgggtacagttaggaaagtttttttcttacaccgtgactgagggaaacattgcttgtctttgagaaattgactgacatactggaagagaacaccattttatctcaggttagtgaagaatcagtgcaggtccctgactcttattttcccagaggccatggagctgagattgagactagccttgtggtttcacactaaagagtttccttgttatgggcaacatgcatgacctaatgtcttgcaaaatccaatagaagtattgcagcttccttctctggctcaagggctgagttaagtgaaaggaaaaacagcacaatggtgaccactgataaaggctttattaggtatatctgaggaagtgggtcacatgaaatgtaaaaagggaatgaggtttttgttgttttttggaagtaaaggcaaacataaatattaccatgatgaattctagtgaaatgaccccttgactttgcttttcttaatacagatatttactgagaggaactatttttataacacaagaaaaatttacaattgattaaaagtatccatgtcttggatacatacgtatctatagagctggcatgtaattcttcctctataaagaataggtataggaaagactgaataaaaatggagggatatccccttggatttcacttgcattgtgcaataagcaaagaagggttgataaaagttcttgatcaaaaagttcaaagaaaccagaattttagacagcaagctaaataaatattgtaaaattgcactatattaggttaagtattatttaggtattataatatgctttgtaaattttatattccaaatattgctcaatatttttcatctattaaattaatttctagtgtaaataagtagcttctatatctgtcttagtctattataattgtaaggagtaaaattaaatgaatagtctgcaggtataaatttgaacaatgcatagatgatcgaaaattacggaaaatcatagggcagagaggtgtgaagattcatcattatgtgaaatttggatctttctcaaatccttgctgaaatttaggatggttctcactgtttttctgtgctgatagtaccctttccaaggtgaccttcagggggattaaccttcctagctcaagcaatgagctaaaaggagccttatgcatgatcttcccacatatcaaaataactaaaaggcactgagtttggcatttttctgcctgctctgctaagacctttttttttttttactttcattataacatattatacatgacattatacaaaaatgattaaaatatattaaaacaacatcaacaatccaggatatttttctataaaactttttaaaaataattgtatctatatattcaattttacatccttnttcaaaggctttgtttttctaaaggctttgttttcctttttattatttttttcttttttatttttttgagacagtcttgctctgtcgctcaggctggagtgcagtggcacgatctcagctcactgcaacctcctcctcccaggttcaagtgattcttgttcatcagcctcccgagtagctgggactacaggcatgtgccactatgcccagctaatttttgtacttttagtagagacagggtttcaccacattggtcaggctggtcttgaaatgctggcgtcaagtgatctgcctgcctccgcctcacaaagcactgggattacaggcatgaatctggccttacgtaatatattttcttaatggctgcataatatcacatcaaataggcatttttcaaacctctttccttattaaacatgtagactatatccattttttactaaaataaataacatttcagataatatctttgcactgataatgttgccaagccatttctaaagtgaccttatcaatttaattaccattggatgagggtgttgctttcatcgcaccattgtagattgtcttttttatttcaatttgcgtttatttataactggttgcaaaggtacacagaacacacgctccttcaacttatctttgataaacccaagcaaggatacaaaaagttggacgacattgagtagagtcatggtatacggtgctgaccctacagtatcagtggaaaagataaggaaaatgtcactactcacctatgttatgcaaaacagttaggtgtgctggggctggatactgctcttttacttgagcattggttgattaaagtttaggtaccatccaggctggtctagagaagtctttggagttaaccatgctctttttgttaaagaagagagtaatgtgtttatcctggctcatagtccgtcaccgaaaatagaaaatgccatccataggtaaaatgctgacctatagaaaaaaatgaactctacttttatagcctagtaaaaatgctctacctgagtagttaaaagcaattcatgaagcctgaagctaaagagcactctgatggttttggcataatagctgcatttccagacctgacctttggccccaaccacaagtgctccaagccccaccagctgaccaaagaaagcccaagttctccttctgtccttcccacaacctccctgctcccaaaactatgaaattaatttgaccatattaacacagctgactcctccagtttacttaaggtagaaagaatgagtttacaacagatgaaaataagtgctttgggcgaactgtattccttttaacagatccaaactattttacatttaaaaaaaaagttaaactaaacttctttactgctgatatgtttcctgtattctagaaaaatttttacactttcacattatttttgtacactttccccatgttaagggatgatggcttttataaatgtgtattcattaaatgttactttaaaaataaaaaacacacacacacacacacaaaaaacaacacccgtgcggcgcccacgggccccagaaaagcctcaacacacatcgtgaggacgcggaccaaaaatgaaacaacgacaaacgtgaccacacggcgggatcccccagagaaacccgagggcagccagcaagacgcatgaagtatcccccccagtaaaaaacagcccgggggagaccacgaggctttagaacaactccagggagatgtaaggcgcagcacagaggacatccc

SEQ ID NO: 359472 - DNA, 2732 bp, Homo sapiens
  misc_feature (2220)..(2220): n is a, c, g, or t
ctgcgtacgcgcacttccggtctttgtggcttgcagctcggggtgggtggctcatttcctggccgctcctgggcttcgcggaaagaagagattactcacactccttctcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgagttgtccagacctcccaaagcttcttcagctatccgttgggaatgtgtttctccaggaagttttcccggcgatatcatagctgctgaggctacacattcaacaatttcttgctttgccatcaacactttgccagccaccatcctgccatctaaaaatgtgaatagaaagtatttttcctgaagaacacatcgtcaataaatcacctgcacccaaatctccatctcaggcgctacttctggcaaggcatatcatgaggctagtgaagcacctacaagaaacttataactcaaggttgtaaaaatggcatggtgactcttacaatcatatcacagtgggcctctccaacaatttaaacctcatgacctaggtgaaagctgtgaaaggatccacattaattcttcagaggcagggctaagactttcaagactgaaaagagactagcataaggagacttaacaggaacccagtcaaggccattcatggccatgggaccacgcataaatggagaacgagtaaattttgctaagtccaaggacattggagagatagagtcactattactgatatggtgactgagtcaacaacatactgccactatgaagtaataagaaaataaaaagttaaaaaatgtaacagataacagttggagggtgaatatattttaaatcaatcagaaaaaaaaaagagtattttattttgtcttgatccccaaacttcagatgaatgtggagaaactgaagcatgtccagagaaaagtggcaagatatccaaacagacagaacacagatgggatcagagggagtgagaggcttagttaaaacaaggtcaggaggctgggcacggtggctcatgcctgtaattccagcactttgggaggccgaggcgggtggataacaaggtcaggagtttgagaacagcctggccaatatggtgaaaccccatctctgctaaaaatacaaaaattagccaggcgtggtggcgggtgcctgtagtcccagctactcgggaggctgaggcaggagaatcacttgaacccaggagttggaggttgtagtgagccaagatcacaccactgcactctagcttgggcgacagagccagactccatctcaaaaaaaaaaaaaaaaaaaaaaaaaaaaaaaaggtcaaagtgcagtgtactcactgcattcaagtatagattgtgttttatgaggactctgtaaactaaagaaagtggattatgaataaattaaagttgggagtatttcatatggacataaggaagaattttaatatagtatgtttactagggtttccacaacaaaataccacagaatgggtggtaaacaacagaaatctcttttctcacaattctagagactagaagtccaagatcaatgtgtcagcaggtttggtttcttctctctccttggcttgcagatgatggccaccttcttttcttgttgttgttgagatagtctcactctgtcatccaggctggagtgcagtggcgcaatctnagctcactgcaacctccaccttctgggctcaggtgaccctcctgtctcagcctcccaagtagctggggctacaggcatgcaccaccatccctggctaatttttgtatttttagtaaagacagggtttcacagtggtcttgaactcctgacctcaagtaatctgcctgcctcaacctcttaaagcgctggcattacaggcataagccactgcacccggccacagatggccactttcttgctaggtcctcacaagatcatcccttggtctgtgttgtgtcctaatctcctcttcttttaaggacatcaattattttggattaaggccaaccctaatgaccccattttaacctttataaaggccctatctctaaaaaaatgcagtcatactctaaggttctggctgggggttacagcttcaacatatgaattttgaagggacacaactcatcccataacaaataacaatatgaaaagcccaagaaacacttaccacagtctctgttccttaagat

SEQ ID NO: 359473 - DNA, 1450 bp, Homo sapiens
ctgcgtacgcgcacttccggtctttgtggcttgcagctcggggtgggtggctcatttcctggccgctcctgggcttcgcggaaagaagagattactcacactccttctcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgattgtgagaacagtgaaacagcaacaaaagagggcatctcagaagaaaaatcacagggactccctcaggaaccttcatttcgaggaattagtgagcagttgtccagacctcccaaagcttcttcagctatccgttgggaatgtgtttctccaggaagttttcccggcgatatcatagctgctgaggctacacattcaacaatttcttgctttgccatcaacactttgccagccaccatcctgccatctaaaaatgtgaatagaaagtatttttcctgaagaacacatcgtcaataaatcacctgcacccaaatctccatctcaggcgctacttctggcaaggcatatcatgaggctagtgaagcacctacaagaaacttataactcaaggttgtaaaaatggcatggtgactcttacaatcatatcacagtgggcctctccaacaatttaaacctcatgacctaggtgaaagctgtgaaaggatccacattaattcttcagaggcagggctaagactttcaagactgaaaagagactagcataaggagacttaacaggaacccagtcaaggccattcatggccatgggaccacgcataaatggagaacgagtaaattttgctaagtccaaggacattggagagatagagtcactattactgatatggtgactgagtcaacaacatactgccactatgaagtaataagaaaataaaaagttaaaaaatgtaacag

SEQ ID NO: 359474 - DNA, 753 bp, Homo sapiens
ctgcgtacgcgcacttccggtctttgtggcttgcagctcggggtgggtggctcatttcctggccgctcctgggcttcgcggaaagaagagattactcacactccttctcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcagcaactttccaagtagtccacagggaaccgcagttgccatgcgaggtattaaccatgttctagagccatcccaaggagttaacatgacctttaacctttaagccctttcaagggcaccaggtttgaaattccttggccattgccctttactcttgcggggttgtctccgctctcccccct

SEQ ID NO: 359475 - DNA, 394 bp, Homo sapiens
aggtggtcatggcaggtccacaggtctaagcttggtccttctcagcaattagtgttgaagattccagtctggtgcatacagccacctccactaaagggaagagagagtcctaattctggtgaacacaggacgtgtttgtgtttaagaggctccttcttgctctcattcccattgtcttccaacaacaactaaatctcagatgccccctcactttggttaactgcagccccagagactgtctcttttagtttcccgacactttttggctcagaaaatagaaactgagaacaccagttccctatcttcttcccacaacctcttccccatcgtcctagcattatctctgttcatgttattgtgttccgtattcctgaatgaataatttcaaagcaaa

SEQ ID NO: 359476 - DNA, 2170 bp, Homo sapiens
ctgcgtacgcgcacttccggtctttgtggcttgcagctcggggtgggtggctcatttcctggccgctcctgggcttcgcggaaagaagagattactcacactccttctcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgattgtgagaacagtgaaacagcaacaaaagagggcatctcagaagaaaaatcacagggactccctcaggaaccttcatttcgaggaattagtgagcatgaaagcaatttagtgtggaagcaaggaagtgctacaggggagaaactaagatctccttcccaagggggcagttttagtcaagtgatcttcacaaacaaatctctaggaaagagagacctttatgatgaggctgaaagatgcttgattctaactacagactctataatgtgtcagaaagttcctccagaagagagaccttatagatgtgatgtatgtgggcacagcttcaagcagcattcctctctaacacaacatcagagaatccatactggagaaaagccctataaatgtaaccagtgtgggaaggcctttagtttgaggtcctatcttattattcatcagagaattcatagtggtgagaaagcatatgaatgtagtgaatgtgggaaagctttcaatcagagctcagccctcattagacatcggaaaatccatactggtgagaaagcttgtaaatgtaatgagtgtggcaaagcattcagtcaaagttcatatctcattatacatcaaagaattcacactggtgagaaaccttatgagtgtaatgaatgtgggaaaacctttagccagagctcaaaactcattagacatcagcgaattcacacaggagagagaccctatgaatgtaatgaatgtggaaaagctttcaggcagagctcagagctgattactcatcagagaatacatagtggagagaaaccctatgaatgtagtgaatgtggaaaagctttcagtttgagctcaaaccttatcagacatcagagaattcatagtggggaggaaccttatcagtgtaatgaatgtggcaaaactttcaaaaggagctcagcccttgttcagcatcagagaattcattctggggatgaagcttatatatgtaatgaatgtgggaaggctttcaggcacagatcggtccttatgcgccatcaaagagtccacactataaagtaatttgtgaatactgtgaatagtgtaaatacttcagtcagatttttaagtttgttagtcaaaagagtttactttggagcaaaactccataaaggttataaaatactaggtcttgagtctagcttgctttgtgcagcatttcccagtgctaatgtaaagtgtcccttgaaagcttttcctgtgactaatcagaacagaatacagaagaatcattacttccagctcttctcttattaggaatactcaggaaatacgaaaagtgggaatgtaacattgaaacctcattttgtatgaaagtgtcatgaatatagcaacccaggctctgtcactgcatctgattgttagtgtgccaggttatggggctggtgtggactgtgtgaggcacttcgtctcaggaactaaaaaaaa

SEQ ID NO: 359477 - DNA, 2767 bp, Homo sapiens
ctgcgtacgcgcacttccggtctttgtggcttgcagctcggggtgggtggctcatttcctggccgctcctgggcttcgcggtgagggacgtgggcccctaggaagagggaggtggggttgggagcgcgcgccggacagtggaggagctccgctcctcggcctgcccatccccaggtcgcggccctttggcccgcgcggcgtctccaagcgactggggaactcagaggaggccagcactcaaactcctgctttccaaaggaaaacgcagttccgctgaccccgtgacttcgtaaatgctgcggtttaaccaaggatataaaaatagaagggctagttagttagttagttagtgcggccggactggttaaaccttaaatttgtaggctaaatattttaattcatctcttaacgttaaccgtagtgtgaggaatgaattttactcatctgtcctgacaaactaagggcatacattcctatcgatatctcgccatcctaaaagcaggtcaagtttggtctgtgtcacaacatttaatacctatttgttaccatattttgcttttgaacatttttagtcttgggatattctaagctttttcagaactgatacggatctctttgctgcttttgtgtatgtgatacctatcatgtttttgaacacatggaaagaagagattactcacactccttctcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagagaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcagggtgggaaccggagaaaagtgatgtgggaaaaggaatttacagcctggagcatgtaatggtatcataacagtcccagctagtccacagggaccagcagtgccatggaaggatttaacatgtctcagagcatcccaagagtcaacagacatccacctccagcccttaaagacacagctgaaatcctggaaaccatgcctttcccctaaaagtgattgtgagaacagtgaaacagcaacaaaagagggcatctcagaagaaaaatcacagggactccctcaggaaccttcatttcgaggaattagtgagcatgaaagcaatttagtgtggaagcaaggaagtgctacaggggagaaactaagatctccttcccaagggggcagttttagtcaagtgatcttcacaaacaaatctctaggaaagagagacctttatgatgaggctgaaagatgcttgattctaactacagactctataatgtgtcagaaagttcctccagaagagagaccttatagatgtgatgtatgtgggcacagcttcaagcagcattcctctctaacacaacatcagagaatccatactggagaaaagccctataaatgtaaccagtgtgggaaggcctttagtttgaggtcctatcttattattcatcagagaattcatagtggtgagaaagcatatgaatgtagtgaatgtgggaaagctttcaatcagagctcagccctcattagacatcggaaaatccatactggtgagaaagcttgtaaatgtaatgagtgtggcaaagcattcagtcaaagttcatatctcattatacatcaaagaattcacactggtgagaaaccttatgagtgtaatgaatgtgggaaaacctttagccagagctcaaaactcattagacatcagcgaattcacacaggagagagaccctatgaatgtaatgaatgtggaaaagctttcaggcagagctcagagctgattactcatcagagaatacatagtggagagaaaccctatgaatgtagtgaatgtggaaaagctttcagtttgagctcaaaccttatcagacatcagagaattcatagtggggaggaaccttatcagtgtaatgaatgtggcaaaactttcaaaaggagctcagcccttgttcagcatcagagaattcattctggggatgaagcttatatatgtaatgaatgtgggaaggctttcaggcacagatcggtccttatgcgccatcaaagagtccacactataaagtaatttgtgaatactgtgaatagtgtaaatacttcagtcagatttttaagtttgttagtcaaaagagtttactttggagcaaaactccataaaggttataaaatactaggtcttgagtctagcttgctttgtgcagcatttcccagtgctaatgtaaagtgtcccttgaaagcttttcctgtgactaatcagaacagaatacagaagaatcattacttccagctcttctcttattaggaatactcaggaaatacgaaaagtgggaatgtaacattgaaacctcattttgtatgaaagtgtcatgaatatagcaacccaggctctgtcactgcatctgattgttagtgtgccaggttatggggctggtgtggactgtgtgaggcacttcgtctcaggaactaaaaaaaa

SEQ ID NO: 359478 - DNA, 1979 bp, Homo sapiens
ctgcgtacgcgcacttccggtctttgtggcttgcagctcggggtgggtggctcatttcctggccgctcctgggcttcgcggaaagaagagattactcacactccttctcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgattgtgagaacagtgaaacagcaacaaaagagggcatctcagaagaaaaatcacagggactccctcaggaaccttcatttcgaggaattagtgagcagttgtccagacctcccaaagcttcttcagctatccgttgggaatgtgtttctccaggaagttttcccggcgatatcatagctgctgaggctacacattcaacaatttcttgctttgccatcaacactttgccagccaccatcctgccatctaaaaatgtgaatagaaagtatttttcctgaagaacacatcgtcaataaatcacctgcacccaaatctccatctcaggcgctacttctggcaaggcatatcatgaggctagtgaagcacctacaagaaacttataactcaaggttgtaaaaatggcatggtgactcttacaatcatatcacagtgggcctctccaacaatttaaacctcatgacctaggtgaaagctgtgaaaggatccacattaattcttcagaggcagggctaagactttcaagactgaaaagagactagcataaggagacttaacaggaacccagtcaaggccattcatggccatgggaccacgcataaatggagaacgagtaaattttgctaagtccaaggacattggagagatagagtcactattactgatatggtgactgagtcaacaacatactgccactatgaagtaataagaaaataaaaagttaaaaaatgtaacagataacagttggagggtgaatatattttaaatcaatcagaaaaaaaaaagagtattttattttgtcttgatccccaaacttcagatgaatgtggagaaactgaagcatgtccagagaaaagtggcaagatatccaaacagacagaacacagatgggatcagagggagtgagaggcttagttaaaacaaggtcaggaggctgggcacggtggctcatgcctgtaattccagcactttgggaggccgaggcgggtggataacaaggtcaggagtttgagaacagcctggccaatatggtgaaaccccatctctgctaaaaatacaaaaattagccaggcgtggtggcgggtgcctgtagtcccagctactcgggaggctgaggcaggagaatcacttgaacccaggagttggaggttgtagtgagccaagatcacaccactgcactctagcttgggcgacagagccagactccatctcaaaaaaaaaaaaaaaaaaaaaaaagtcgacgcggccgcgaatttagtactagta

SEQ ID NO: 359479 - DNA, 2136 bp, Homo sapiens
  misc_feature (1624)..(1624): n is a, c, g, or t
attcaaggacactgtgttctgtggggattcttctgttgaaggttgccagactgaaatgtctgtcctgggaaggaagctgactgattttgttccctgcagcatttcccttttgcttcttagagttgtccagacctcccaaagcttcttcagctatccgttgggaatgtgtttctccaggaagttttcccggcgatatcatagctgctgaggctacacattcaacaatttcttgctttgccatcaacactttgccagccaccatcctgccatctaaaaatgtgaatagaaagtatttttcctgaagaacacatcgtcaataaatcacctgcacccaaatctccatctcaggcgctacttctggcaaggcatatcatgaggctagtgaagcacctacaagaaacttataactcaaggttgtaaaaatggcatggtgactcttacaatcatatcacagtgggcctctccaacaatttaaacctcatgacctaggtgaaagctgtgaaaggatccacattaattcttcagaggcagggctaagactttcaagactgaaaagagactagcataaggagacttaacaggaacccagtcaaggccattcatggccatgggaccacgcataaatggagaacgagtaaattttgctaagtccaaggacattggagagatagagtcactattactgatatggtgactgagtcaacaacatactgccactatgaagtaataagaaaataaaaagttaaaaaatgtaacagataacagttggagggtgaatatattttaaatcaatcagaaaaaaaaaagagtattttattttgtcttgatccccaaacttcagatgaatgtggagaaactgaagcatgtccagagaaaagtggcaagatatccaaacagacagaacacagatgggatcagagggagtgagaggcttagttaaaacaaggtcaggaggctgggcacggtggctcatgcctgtaattccagcactttgggaggccgaggcgggtggataacaaggtcaggagtttgagaacagcctggccaatatggtgaaaccccatctctgctaaaaatacaaaaattagccaggcgtggtggcgggtgcctgtagtcccagctactcgggaggctgaggcaggagaatcacttgaacccaggagttggaggttgtagtgagccaagatcacaccactgcactctagcttgggcgacagagccagactccatctcaaaaaaaaaaaaaaaaaaaaaaaaaaaaaaaaggtcaaagtgcagtgtactcactgcattcaagtatagattgtgttttatgaggactctgtaaactaaagaaagtggattatgaataaattaaagttgggagtatttcatatggacataaggaagaattttaatatagtatgtttactagggtttccacaacaaaataccacagaatgggtggtaaacaacagaaatctcttttctcacaattctagagactagaagtccaagatcaatgtgtcagcaggtttggtttcttctctctccttggcttgcagatgatggccaccttcttttcttgttgttgttgagatagtctcactctgtcatccaggctggagtgcagtggcgcaatctnagctcactgcaacctccaccttctgggctcaggtgaccctcctgtctcagcctcccaagtagctggggctacaggcatgcaccaccatccctggctaatttttgtatttttagtaaagacagggtttcacagtggtcttgaactcctgacctcaagtaatctgcctgcctcaacctcttaaagcgctggcattacaggcataagccactgcacccggccacagatggccactttcttgctaggtcctcacaagatcatcccttggtctgtgttgtgtcctaatctcctcttcttttaaggacatcaattattttggattaaggccaaccctaatgaccccattttaacctttataaaggccctatctctaaaaaaatgcagtcatactctaaggttctggctgggggttacagcttcaacatatgaattttgaagggacacaactcatcccataacaaataacaatatgaaaagcccaagaaacacttaccacagtctctgttccttaagat

SEQ ID NO: 359480 - DNA, 1533 bp, Homo sapiens
ctgcgtacgcgcacttccggtctttgtggcttgcagctcggggtgggtggctcatttcctggccgctcctgggcttcgcggtgagggacgtgggcccctaggaagagggaggtggggttgggagcgcgcgccggacagtggaggagctccgctcctcggcctgcccatccccaggtcgcggccctttggcccgcgcggcgtctccaagcgactggggaactcagaggaggccagcactcaaactcctgctttccaaaggaaaacgcagttccgctgaccccgtgacttcgtaaatgctgcggtttaaccaaggatataaaaatagaagggctagttagttagttagttagtgcggccggactggttaaaccttaaatttgtaggctaaatattttaattcatctcttaacgttaaccgtagtgtgaggaatgaattttactcatctgtcctgacaaactaagggcatacattcctatcgatatctcgccatcctaaaagcaggtcaagtttggtctgtgtcacaacatttaatacctatttgttaccatattttgcttttgaacatttttagtcttgggatattctaagctttttcagaactgatacggatctctttgctgcttttgtgtatgtgatacctatcatgtttttgaacacatggaaagaagagattactcacactccttctcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagagaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtggtgaggaatgggaaatcatctggaaactcttgacacttaggcctctgtttttgagaatgcagaattaattgcacttgacaaacttgccacatgtgagcatcacctttattattctaaaccagaggtgctcgctttagcgggctttgtattcaccccttcatgaattggtgtcagccctccctgtgtgagtttccctgttattcattcattcatttcattatgttgtaactttataaagcgtcaatacatgtctggtactgtggtaggccccaggagaggtttcaggtcta

SEQ ID NO: 359481 - DNA, 1276 bp, Homo sapiens
ctgcgtacgcgcacttccggtctttgtggcttgcagctcggggtgggtggctcatttcctggccgctcctgggcttcgcggaaagaagagattactcacactccttctcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcagggtgggaaccggagaaaagtgatgtgggaaaaggaatttacagcctggagcatgtaatggtatcataacagtaggataaaaatttttatgtctctacttgaaccctaacctgaagtgactaatagagccatacttgtctatacccttgaatggtctttttcccctgtccttcatccctggagatgtcatcattgacctctttgagatttttactaagcaagttttcttagggattttctcacaaagctaaccatattttactgatttcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtggtgaggaatgggaaatcatctggaaactcttgacacttaggcctctgtttttgagaatgcagaattaattgcacttgacaaacttgccacatgtgagcatcacctttattattctaaaccagaggtgctcgctttagcgggctttgtattcaccccttcatgaattggtgtcagccctccctgtgtgagtttccctgttattcattcattcatttcattatgttgtaactttataaagcgtcaatacatgtctggtactgtggtaggccccaggagaggtttcaggtcta

SEQ ID NO: 359482 - DNA, 1006 bp, Homo sapiens
ctgcgtacgcgcacttccggtctttgtggcttgcagctcggggtgggtggctcatttcctggccgctcctgggcttcgcggaaagaagagattactcacactccttctcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtggtgaggaatgggaaatcatctggaaactcttgacacttaggcctctgtttttgagaatgcagaattaattgcacttgacaaacttgccacatgtgagcatcacctttattattctaaaccagaggtgctcgctttagcgggctttgtattcaccccttcatgaattggtgtcagccctccctgtgtgagtttccctgttattcattcattcatttcattatgttgtaactttataaagcgtcaatacatgtctggtactgtggtaggccccaggagaggtttcaggtcta

SEQ ID NO: 359483 - DNA, 2123 bp, Homo sapiens
ctgcgtacgcgcacttccggtctttgtggcttgcagctcggggtgggtggctcatttcctggccgctcctgggcttcgcggaaagaagagattactcacactccttctcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgattgtgagaacagtgaaacagcaacaaaagagggcatctcagaagaaaaatgaaagcaatttagtgtggaagcaaggaagtgctacaggggagaaactaagatctccttcccaagggggcagttttagtcaagtgatcttcacaaacaaatctctaggaaagagagacctttatgatgaggctgaaagatgcttgattctaactacagactctataatgtgtcagaaagttcctccagaagagagaccttatagatgtgatgtatgtgggcacagcttcaagcagcattcctctctaacacaacatcagagaatccatactggagaaaagccctataaatgtaaccagtgtgggaaggcctttagtttgaggtcctatcttattattcatcagagaattcatagtggtgagaaagcatatgaatgtagtgaatgtgggaaagctttcaatcagagctcagccctcattagacatcggaaaatccatactggtgagaaagcttgtaaatgtaatgagtgtggcaaagcattcagtcaaagttcatatctcattatacatcaaagaattcacactggtgagaaaccttatgagtgtaatgaatgtgggaaaacctttagccagagctcaaaactcattagacatcagcgaattcacacaggagagagaccctatgaatgtaatgaatgtggaaaagctttcaggcagagctcagagctgattactcatcagagaatacatagtggagagaaaccctatgaatgtagtgaatgtggaaaagctttcagtttgagctcaaaccttatcagacatcagagaattcatagtggggaggaaccttatcagtgtaatgaatgtggcaaaactttcaaaaggagctcagcccttgttcagcatcagagaattcattctggggatgaagcttatatatgtaatgaatgtgggaaggctttcaggcacagatcggtccttatgcgccatcaaagagtccacactataaagtaatttgtgaatactgtgaatagtgtaaatacttcagtcagatttttaagtttgttagtcaaaagagtttactttggagcaaaactccataaaggttataaaatactaggtcttgagtctagcttgctttgtgcagcatttcccagtgctaatgtaaagtgtcccttgaaagcttttcctgtgactaatcagaacagaatacagaagaatcattacttccagctcttctcttattaggaatactcaggaaatacgaaaagtgggaatgtaacattgaaacctcattttgtatgaaagtgtcatgaatatagcaacccaggctctgtcactgcatctgattgttagtgtgccaggttatggggctggtgtggactgtgtgaggcacttcgtctcaggaactaaaaaaaa

SEQ ID NO: 359484 - DNA, 2440 bp, Homo sapiens
ctgcgtacgcgcacttccggtctttgtggcttgcagctcggggtgggtggctcatttcctggccgctcctgggcttcgcggaaagaagagattactcacactccttctcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcagggtgggaaccggagaaaagtgatgtgggaaaaggaatttacagcctggagcatgtaatggtatcataacagtaggataaaaatttttatgtctctacttgaaccctaacctgaagtgactaatagagccatacttgtctatacccttgaatggtctttttcccctgtccttcatccctggagatgtcatcattgacctctttgagatttttactaagcaagttttcttagggattttctcacaaagctaaccatattttactgatttcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgattgtgagaacagtgaaacagcaacaaaagagggcatctcagaagaaaaatcacagggactccctcaggaaccttcatttcgaggaattagtgagcatgaaagcaatttagtgtggaagcaaggaagtgctacaggggagaaactaagatctccttcccaagggggcagttttagtcaagtgatcttcacaaacaaatctctaggaaagagagacctttatgatgaggctgaaagatgcttgattctaactacagactctataatgtgtcagaaagttcctccagaagagagaccttatagatgtgatgtatgtgggcacagcttcaagcagcattcctctctaacacaacatcagagaatccatactggagaaaagccctataaatgtaaccagtgtgggaaggcctttagtttgaggtcctatcttattattcatcagagaattcatagtggtgagaaagcatatgaatgtagtgaatgtgggaaagctttcaatcagagctcagccctcattagacatcggaaaatccatactggtgagaaagcttgtaaatgtaatgagtgtggcaaagcattcagtcaaagttcatatctcattatacatcaaagaattcacactggtgagaaaccttatgagtgtaatgaatgtgggaaaacctttagccagagctcaaaactcattagacatcagcgaattcacacaggagagagaccctatgaatgtaatgaatgtggaaaagctttcaggcagagctcagagctgattactcatcagagaatacatagtggagagaaaccctatgaatgtagtgaatgtggaaaagctttcagtttgagctcaaaccttatcagacatcagagaattcatagtggggaggaaccttatcagtgtaatgaatgtggcaaaactttcaaaaggagctcagcccttgttcagcatcagagaattcattctggggatgaagcttatatatgtaatgaatgtgggaaggctttcaggcacagatcggtccttatgcgccatcaaagagtccacactataaagtaatttgtgaatactgtgaatagtgtaaatacttcagtcagatttttaagtttgttagtcaaaagagtttactttggagcaaaactccataaaggttataaaatactaggtcttgagtctagcttgctttgtgcagcatttcccagtgctaatgtaaagtgtcccttgaaagcttttcctgtgactaatcagaacagaatacagaagaatcattacttccagctcttctcttattaggaatactcaggaaatacgaaaagtgggaatgtaacattgaaacctcattttgtatgaaagtgtcatgaatatagcaacccaggctctgtcactgcatctgattgttagtgtgccaggttatggggctggtgtggactgtgtgaggcacttcgtctcaggaactaaaaaaaa

SEQ ID NO: 359485 - DNA, 2561 bp, Homo sapiens
  misc_feature (2049)..(2049): n is a, c, g, or t
ctgcgtacgcgcacttccggtctttgtggcttgcagctcggggtgggtggctcatttcctggccgctcctgggcttcgcggaaagaagagattactcacactccttctcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgatttttcctgaagaacacatcgtcaataaatcacctgcacccaaatctccatctcaggcgctacttctggcaaggcatatcatgaggctagtgaagcacctacaagaaacttataactcaaggttgtaaaaatggcatggtgactcttacaatcatatcacagtgggcctctccaacaatttaaacctcatgacctaggtgaaagctgtgaaaggatccacattaattcttcagaggcagggctaagactttcaagactgaaaagagactagcataaggagacttaacaggaacccagtcaaggccattcatggccatgggaccacgcataaatggagaacgagtaaattttgctaagtccaaggacattggagagatagagtcactattactgatatggtgactgagtcaacaacatactgccactatgaagtaataagaaaataaaaagttaaaaaatgtaacagataacagttggagggtgaatatattttaaatcaatcagaaaaaaaaaagagtattttattttgtcttgatccccaaacttcagatgaatgtggagaaactgaagcatgtccagagaaaagtggcaagatatccaaacagacagaacacagatgggatcagagggagtgagaggcttagttaaaacaaggtcaggaggctgggcacggtggctcatgcctgtaattccagcactttgggaggccgaggcgggtggataacaaggtcaggagtttgagaacagcctggccaatatggtgaaaccccatctctgctaaaaatacaaaaattagccaggcgtggtggcgggtgcctgtagtcccagctactcgggaggctgaggcaggagaatcacttgaacccaggagttggaggttgtagtgagccaagatcacaccactgcactctagcttgggcgacagagccagactccatctcaaaaaaaaaaaaaaaaaaaaaaaaaaaaaaaaggtcaaagtgcagtgtactcactgcattcaagtatagattgtgttttatgaggactctgtaaactaaagaaagtggattatgaataaattaaagttgggagtatttcatatggacataaggaagaattttaatatagtatgtttactagggtttccacaacaaaataccacagaatgggtggtaaacaacagaaatctcttttctcacaattctagagactagaagtccaagatcaatgtgtcagcaggtttggtttcttctctctccttggcttgcagatgatggccaccttcttttcttgttgttgttgagatagtctcactctgtcatccaggctggagtgcagtggcgcaatctnagctcactgcaacctccaccttctgggctcaggtgaccctcctgtctcagcctcccaagtagctggggctacaggcatgcaccaccatccctggctaatttttgtatttttagtaaagacagggtttcacagtggtcttgaactcctgacctcaagtaatctgcctgcctcaacctcttaaagcgctggcattacaggcataagccactgcacccggccacagatggccactttcttgctaggtcctcacaagatcatcccttggtctgtgttgtgtcctaatctcctcttcttttaaggacatcaattattttggattaaggccaaccctaatgaccccattttaacctttataaaggccctatctctaaaaaaatgcagtcatactctaaggttctggctgggggttacagcttcaacatatgaattttgaagggacacaactcatcccataacaaataacaatatgaaaagcccaagaaacacttaccacagtctctgttccttaagat

SEQ ID NO: 359486 - DNA, 1169 bp, Homo sapiens
ctgcgtacgcgcacttccggtctttgtggcttgcagctcggggtgggtggctcatttcctggccgctcctgggcttcgcggaaagaagagattactcacactccttctcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgattgtgagaacagtgaaacagcaacaaaagagggcatctcagaagaaaaatcacagggactccctcaggaaccttcatttcgaggaattagtgagcagttgtccagacctcccaaagcttcttcagctatccgttgggaatgtgtttctccaggaagttttcccggcgatatcatagctgctgaggctacacattcaacaatttcttgctttgccatcaacactttgccagccaccatcctgccatctaaaaatgtgaatagaaagtgtaagtatcatttacttcccatgacagaagaaactgttgtagcaggaacacaaactcaatgaaataggtatttatttattaggaggacagttctcaaaactagattcccaatctagaattcagagaagtggcctggggtagccaaatatggccccctgtcggcatgtaggggtcctctagcgcccc

SEQ ID NO: 359487 - DNA, 6457 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359488 - DNA, 730 bp, Homo sapiens
gaattaaaggagacaaaaagaggcagagcgagtagagagcagcccaacactcctgcacctgtcccacctgcgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagagtgaagagcgggcagccacagttaccaagaagacttatgagatctggcgtccgtagcggggattgaccttaactgggtgatagcccgggattcattaaaccatgggatatgccgcggtggcaagacattcagaattgaaccagatatgcccatcctcaattaagccttcaagggtgaaatgaccgggggaatgcttagagatcagatg

SEQ ID NO: 359489 - DNA, 444 bp, Homo sapiens
gacatgctcttcaaccttttgctgcaggctcttttcctcattcagggaatgtttgtgagtctctttcccatccatcttgtcggtcagctggttagtctcctgcacctgtcccacctgcgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtaaaggtatccacattttttttgtttgtttgtttgttttgagacagtgtagtgctgccgccaggctggagtgctgtggcgcgatcttggcttactg

SEQ ID NO: 359490 - DNA, 6418 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359491 - DNA, 5471 bp, Homo sapiens
ggcgtttcccacagaacaagatgagactaggctccctgtataacggtgcttgctgggattctggtgtccccagtgagagagtactcccctctctgccactctgtccttccccttggcttgaacgtctaaccttattctttttcatcctgccagagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359492 - DNA, 5209 bp, Homo sapiens
  misc_feature (20)..(20): n is a, c, g, or t
  misc_feature (24)..(24): n is a, c, g, or t
taacggctaggtacgaggcngggntaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359493 - DNA, 6437 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359494 - DNA, 6457 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcaggcccaacactcctgcacctgtcccacctgcgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359495 - DNA, 6508 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagagtgaagagcgggcagccacagttaccaagaagacttatgagatctggcgtccgtagcggggattgaccttaactgggtgatagcccgggattcattaaaccatgggatatgccgcggtggcaagacattcagaattgaaccagatatgcccatcctcaattaagccttcaagggtgaaatgaccgggggaatgcttagagatcagatg

SEQ ID NO: 359496 - DNA, 2629 bp, Homo sapiens
gagacaacaaagagggagaagatagcagtgttatccactacgatgataaggccattgaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359497 - DNA, 6348 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagagtgaagagcgggcagccacagttaccaagaagacttatgagatctggcgtccgtagcggggattgaccttaactgggtgatagcccgggattcattaaaccatgggatatgccgcggtggcaagacattcagaattgaaccagatatgcccatcctcaattaagccttcaagggtgaaatgaccgggggaatgcttagagatcagatg

SEQ ID NO: 359498 - DNA, 5128 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359499 - DNA, 5780 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaaggtgagcggttggggaggaatatattgcttaagtgacaaacttgaaagtgcgtaacgtcctgcagctacttggcaggctgaggcaggagaatcgcttaaacccgggaggcagaggttgcagtgagctgagatcatggcattgcactccagcatgggcaacagagcaagaatctgtctcaaaataaataaataaataaataaataaaat

SEQ ID NO: 359500 - DNA, 1964 bp, Homo sapiens
aagaaaaaatatgaccagcaggatcaccatccccgaaaaactcctacaccctccactccaggtgacacgcagcccaacactcctgcacctgtcccacctgctgaagatgggataaaaatagaggaaaatagcctcaagcaagaagagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359501 - DNA, 5380 bp, Homo sapiens
  misc_feature (5319)..(5319): n is a, c, g, or t
  misc_feature (5350)..(5350): n is a, c, g, or t
  misc_feature (5364)..(5364): n is a, c, g, or t
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcatagatctgacccctattgtggtagaagacaaagaagagaagaaagaagaagaagagaaaaaagaggtgatgcttcagaatggagagacccccaaggacctgaatgatgagaaacagaagaaaaatattaaacccccaaaaaacccggggttttttttttncccaaaattttgggggttttttttttttttnaaaaaaaacccccnaattttttggggcccc

SEQ ID NO: 359502 - DNA, 5323 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359503 - DNA, 5553 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagagtgaagagcgggcagccacagttaccaagaagacttatgagatctggcgtccgtagcggggattgaccttaactgggtgatagcccgggattcattaaaccatgggatatgccgcggtggcaagacattcagaattgaaccagatatgcccatcctcaattaagccttcaagggtgaaatgaccgggggaatgcttagagatcagatg

SEQ ID NO: 359504 - DNA, 1818 bp, Homo sapiens
  misc_feature (37)..(37): n is a, c, g, or t
tcataggttcgcaggatggcaggaaacaagccagccnatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggcagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaactgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359505 - DNA, 1501 bp, Homo sapiens
  misc_feature (8)..(8): n is a, c, g, or t
acaggccnccaagctcagaagcgcgaaaggtctgaggaagcacaagacacacacacacacacacacacacacacacacacacacacacacagaaagagagagagagagagagaggaaggacggggaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359506 - DNA, 5154 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggctagtcgggggggtaccgaggctcgaatgc

SEQ ID NO: 359507 - DNA, 4330 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgaggtgtgtgtggccggccccgccccccacccatgggccgttccactagagcagtgggccc

SEQ ID NO: 359508 - DNA, 3884 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagggtggggccggggggcccagacggtcatgtccaacagagtgggaatccaatggccgggacatccggtgacccgggggggg

SEQ ID NO: 359509 - DNA, 3778 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatggtgagagagaaggagttgtttagtttcaggaatcctcatttgcttatatctttggactgtaacttcttgtgcatctccttttctgtgtagttcttttgggactttgtcatttgagatggagtaaagcttttgaatgtctcaattggacgaatgtattggactattcctaggagattttttcttttggggtatttgttctttctgctagaaagaagaaagcattgta

SEQ ID NO: 359510 - DNA, 3128 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtagcgtggtaagggcgatgagtgtggggaggaatggggtgggttcttgtatgttcaaactgtcattctatttatacgttgttagatatggggagtagtgtgagtcgagtcgagtaga

SEQ ID NO: 359511 - DNA, 2064 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggagggatgagcataaggagggatgagca

SEQ ID NO: 359512 - DNA, 202 bp, Homo sapiens
cagcagagggagtctgtccatccagcgcactgttctcactttcttcattctatggaaggctttgctcccaagtaacttacacattagggttgaagacacacagaattgaaagttaactaactgtacatgagctgtaggtgactatgtgtccaatcagtgacacactagtgcagaggggtttgtttggggaacactgcagatt

SEQ ID NO: 359513 - DNA, 472 bp, Homo sapiens
agggaggaatgagtctgggattttggagggaaatttgggaatctgaatgtggggaagcaagcttaggtggagaagattttattttccccatctttggtcttgtggtatatatttggatatatcctgattttaggtcccaatgctcggaggaagcccaagggcagccctcgtgtacctgatgccaagaagcctaaacccaagaaagtagctcccctgaaaatcaagctgggaggttttggttccaagcgtaagagatcctcggtgagagcccagcccatcgctttagggagggtgccatgtctaatagaaaggatgtgaccttctatcagaacctgtccttcatagtaggcacgtaagaatgtggggcgtttcccacagaacaagatgagactaggctccctgtataacggtgcttgctgggattctggtgtccccagtgagagagtactcccctctctgccactctgtcctt

SEQ ID NO: 359514 - DNA, 415 bp, Homo sapiens
ggttgggtcttctccatgtgggctttcttttaatacttttttctttgcatttgttctcaggaagctcctaagatgcctaatggcatgtatgatggcagtgccctaatcagagcatctgggaaattattgctgctgcagaaaatgctcaagaaccttaaggagggtgggcatcgtgtactcatcttttcccaggtatcatgtggactgggagctttagggaacagtcatagacaacccttagtgacctaaggaaagggattaccatctgactcttccataattaaaccgtgcttcttttgcagatgaccaagatgctagacctgctagaggatttcttggaacatgaaggttataaatacgaacgcatcgatggtggaatcactgggaacatgcggcaagaggccattgaccgctt

SEQ ID NO: 359515 - DNA, 824 bp, Homo sapiens
  misc_feature (20)..(20): n is a, c, g, or t
  misc_feature (24)..(24): n is a, c, g, or t
taacggctaggtacgaggcngggntaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaggacaggcccaatttgggagagggggaccgttatgcaggggtaaccccggtgtttcccggctctc

SEQ ID NO: 359516 - DNA, 6436 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359517 - DNA, 5564 bp, Homo sapiens
tgggattttggagggaaatttgggaatctgaatgtggggaagcaagcttaggtggagaagattttattttccccatctttggtcttgtggtatatatttggatatatcctgattttaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359518 - DNA, 6543 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaggaaaaaaccaaaagcataaaaaaccacagcaaatttcttgatgaaaattgaaaataaaagtttccttgtatttt

SEQ ID NO: 359519 - DNA, 6384 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaagatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359520 - DNA, 6619 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggttcctctgttctctccttcagtccctgaccctgcctcagaggatgagaaggtcgttgtggaaccccctgagggagaggagaaagtggaaaaaggcagagggtgagggtagaagatacaggagagaagagctatggagcacaggagccctaaaggttgttgctgatgataggaaaaggtgttaggaaaaagtctagcataatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359521 - DNA, 6074 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcaggaaaagcgaggtccactcacgtgaacgacttccatacctggccagtccccgggccgccactcttgcactccggcagaaccagacgggaaggagggaggcccctaagagactagaagagcaataccg

SEQ ID NO: 359522 - DNA, 5764 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtttgaacagatgagaacttgttgtgcatgaagctgatggactcgattcagtaccaatgca

SEQ ID NO: 359523 - DNA, 5485 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaacatcccaattcctcatcctggga

SEQ ID NO: 359524 - DNA, 5103 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccagctcctgccagggctgttaccgttgttttcttgaatcactcacaatgagaaactaacattttgctttttgtaataaagttaatttatattcagttccc

SEQ ID NO: 359525 - DNA, 1740 bp, Homo sapiens
tgagccaccacgcctggctaatttttgtacttttagtagagacagggtttcaccatgttggccaggctggtttctaactcctcacctcaggtgatccacccaccttggcctccccaagtgctgggattacaggcatgagccaccgcacccagctaatttttgtatttttaatagagattggggttcaccttgttggccaggctggtcttgaactcctgacctcaagtgatctgcctgctgctgtctcccaagatgctgggattacaggcatgagccaccatgcccagctgacattactgtaattgcagacatttagatgtgggtctatccaattggataatagtgtgcaacagaggagaatgttcttcctttaggtatagtctcaataacatttcttcccctaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtgga

SEQ ID NO: 359526 - DNA, 4813 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggactgttgtggagtaagcactctctgtgtggagaagca

SEQ ID NO: 359527 - DNA, 4025 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggatcgtagagtggcacatgcttacagggcattggtgccaagtccagtggatgagaatccagcccctcacaagctgtgggatggggcttgggagttgcggtggacccctcttct

SEQ ID NO: 359528 - DNA, 3412 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaactcctaattgtgaacgggatcatctagat

SEQ ID NO: 359529 - DNA, 3171 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaattaggaaggtttacgggaggagttagctgacattgccaaggaggaccagataaaaaaactgcacgacatatacctaggctaggtatatgtcgtgcgaggctgaccttctcactcagcatcatggatccaagcctgttgagagaaagggagctgttcaaaaaacgagctcattccactcctgt

SEQ ID NO: 359530 - DNA, 1296 bp, Homo sapiens
ccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaatcgtgcggtaccgagctgattta

SEQ ID NO: 359531 - DNA, 433 bp, Homo sapiens
taccccgcgtcaaagtaacttaaatttttttattgatgttttaaaatagctttggcttggaacgtcagaagataggaaattttcgttattttatttattctttttttttttttttttttttttagggccaagaaaaaagaaaagaaacttaaatgattccagcctatttgtatctgctgaagaggtaaggctaatgtactgttttaacaagctagctattctacattatttttagttttctaataaatttatcgtttttgtttaaaagtttggccatctattggatgaaaatatgggatccaagtttgataacattggcatgaatgccatggctaacaaagataatgcaagtaagtaacttaaatttttttattgatgttttaaaaatagctttggcttggaacttcagaagataggaaattttcgttacttt

SEQ ID NO: 359532 - DNA, 1759 bp, Homo sapiens
agcggaggctgagtttcacgcgcgtatgctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctacttctcctatctctcccagtcctagctgctggcatcactatactactaacagaccgcaacctcaacaccaccttcttcgaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggtctgagctatgatatcaatgtggcttcctagggtttatcgtgtgagcacaccatatattacagtaggaatagacgtagacacaccgagcatatttcaccctccgcttacataatcaatcgctaatccccaacggggtcaagtatttaagctgatccgccacactccacggagcactttggaatgatcctgctgaggctcttagccaggatcatcttcttcccggagagggccggacgggcttgtttacaactcaccttaaaccgcacacagacagccaggtggggcaaccatgcataagaggctgcccaacgggactaagcacatcgtacggccaacgacgcatcatcggcttcccctcaaccgcctcaactacaaaatactctagccagtcccccaccgacacagacgacacacagcacgaagacggcagcgaaagagcaggcaccagacgaaaaagagcaccacgaccaccaaccacaccagaacacagcagacagagagagcgaagaagagacaaggcaggagaaagtacagcaaagctgtcgaaacgcaaggacaaacgagccagacagacagcgagagagacagggagaggaagaagagaacaggccagcgacaggaacgcaggcacagaacagagcaacaacacagacgcagaagaaacgacagcaaaacagaagaagcacgaccgaagggaacagaggcgcgagcagagagaggagagcagccaagaagggaagaaaacacacaaaacagagaaccagacgggaacagacacagaaaaccgagaacagggcacagcgcaggcgcggaagagcggacgacgaaacagcaggacgagcgcgccgaaagacacaacaagacagagaaccataagacatcgacggcaagcaggaggcacggacacgccacagcggcgagcaaccaaaccaggagaaagagacagcaagcggagagaaggaaacacaggacgtagacagagacagagagacagcacacgaagcagaggtgacagaagctcgaacgagaggcagaggaggggaagagaggaagagcagagagcggaggcgcggcaagaggagaagagcagacgacagaaacaggaagacgaacagacacgagaaagacacgcacacacgcgacaagcgcaggacggcagcagcagcagaagagagagcagcaagagagagcgcgcgctggagaaagaacgcaacggcaacagaggagcaagtgaggaggtgcaggagcaggctggggggaaggaggagaggcgagaagtagacacgacgcgcacccgcagggc

SEQ ID NO: 359533 - DNA, 902 bp, Homo sapiens
ttggtcctctcttttgtttttgctctttgttcttttttttttttgtgttctctctttcttttttgtcttttctttctttttcgctttttttcggttgtctttgatccgttacgctgtcgttctgctttggcgctctgtctttcttcgtgttgtgccccattttgcagtttcgtctttcatgctgtcttgtgctgtatggttcgcctccgtttcggcgtctagcattcggtctgttaccgttcagtcccttcgttcttctacctttattgctattgtatttccgtaaggtgtcttttagggtctgggttgtaccataagggacatgagttgtatcatgtcctggaccgtccaggtagttcattaaagagttctgtgatattgattcattgttaagttaattaagagatctgcttgggtgcagttagtctcttacatgtgtaagtttccaagggttcttgtagacacgtttttacttgtttcgtatcagctacccaacggttcctgtgtactttcgcagaagatgcagacctgcaacattcgacaagcattcctgaagaatcgactgtgttcccacacactgctgagagtgtgggtttcctcagagaagaaaggattctgaaatggtgaatgtgtataatcccacaggttggttctaattaagtctctgcacacagataaactgcaagacgtttctttcggactatatcccacaggtttttgttttttttttgagagggatttttgctcttgttgcccaggctggagtgcagtggcacgatctcactctctgattccatacattccagacttctcagtggatttgtaataaacttccaagatgaagggatatttcttgctcattgtttgcctgaaatctgaggtgcgttcaagggggactgcgc

SEQ ID NO: 359534 - DNA, 3356 bp, Homo sapiens
agcggaggctgagtttcacgcgcgtatgctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttaattgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattggcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatctaatttttgctgttcaaccatgttttttgatctagctctctgattccatacattccagacttctcagtggatttgtaataaactataaataaaaatagctctcatttataaa

SEQ ID NO: 359535 - DNA, 3304 bp, Homo sapiens
agcggaggctgagtttcacgcgcgtatgctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttaattgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagaggtaaggctaatgtactgttttaacaagctagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatctaatttttgctgttcaaccatgttttttgatctagctctctgattccatacattccagacttctcagtggatttgtaataaactataaataaaaatagctctcatttataaa

SEQ ID NO: 359536 - DNA, 3231 bp, Homo sapiens
agcggaggctgagtttcacgcgcgtatgctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttaattgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagaggtaaggctaatgtactgttttaacaagctagctattctacattatttttagttttctaataaatttatcgtttttgtttaaaagtttggccatctattggatgaaaatatgggatccaagtttgataacattggcatgaatgccatggctaacaaagataatgcaagtaagtaacttaaatttttttattgatgttttaaaaatagctttggcttggaacttcagaagataggaaattttcgttacttt

SEQ ID NO: 359537 - DNA, 2694 bp, Homo sapiens
agcggaggctgagtttcacgcgcgtatgctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttaattgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctggtaagtataaaccttagacagttgaaactgaaaagacaatataagacaaagatgcataaattgtattattctttgttctaatttatcagaataaaacctgagcatcaaagacattatccatcttttttcccaagaataggtattcttaaatctactgtatctgactgggcctttttttttttttttttaactttattacagcaaatttgaaacatatccaaaataaacaaaatagtatgatgaaccccctccccattaccatcacccagctttga

SEQ ID NO: 359538 - DNA, 737 bp, Homo sapiens
caaagttcatcacggttctccgcatacgtcagaaactgaccgcagtacttaagcactaccacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattggcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatctaatttttgctgttcaaccatgttttttgatctagctctctgattccatacattccagacttctcagtggatttgtaataaactataaataaaaatagctctcatttataaa

SEQ ID NO: 359539 - DNA, 650 bp, Homo sapiens
tcatctgaacagttctattaggatgttgttagctttttgaaaatattatatactaactcttaaattatatttaaatgccagctacccaatggtgccagaagattattgcaattgtttttacccaagtataatttttaaaataaaatcatgttgcattgcatttttctaaaatcattagatttataattgaataatgtagacttacaattttttttagggccaagaaaaaagaaaagaaacttaaatgattccagcctatttgtatctgctgaagagtttggccatctattggatgaaaatatgggatccaagtttgataacattggcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatctaatttttgctgttcaaccatgttttttgatctagctctctgattccatacattccagacttctcagtggatttgtaataaactataaataaaaatagctctcatttataaa

SEQ ID NO: 359540 - DNA, 484 bp, Homo sapiens
tacttggattcatagacataatttgaattaagtttttaaatccccgctccacttttcagggaaactatattcagtattcaggggacccactgcaggatttcactctaatgagatttttggatcgatttgtataccgaaatccaaagccccataaaggcaaaggtatgcttctatttagtgaattatttggctttcatttttaatacataataaacaatatgagcttataactaggttttgcattatactgtcataattttacatttcagaaaacacagatagtgttgtgatgcagccgaaaagaaaacattttattaaggatattcgtcatcttcctggtaagtataaaccttagacagttgaaactgaaaagacaatataagacaaagatgcataaattgtattattctttgttctaatttatcagaataaaacctgagcatcaaagacattatccatcttttttcccaagaataggtattct

SEQ ID NO: 359541 - DNA, 3628 bp, Homo sapiens
agcggaggctgagtttcacgcgcgtatgctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttaattgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattggcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatctaatttttgctgttcaaccatgttttttgatctagctctctgattccatacattccagacttctcagtggatttgtaataaactataaataaaaatagctctcatttataaagtcatgtggaaacattgttaaaattaaatgtattgaaaaaaacaacttcttttttccatattgctacataacaaaatgaaaaagaggacagtaggattacagacttcacatataagtcctggcatctctgatcattgtaatgagcactatttcgtctaactacatgatgtcatcttgttcagtctttatctacttgacagagaaagagacagctccaagaagttagcaaacctgagatgaaactgatcttttaaaaccaaaggtttaaactg

SEQ ID NO: 359542 - DNA, 3266 bp, Homo sapiens
cgtggagagttccgaaggtggctaggctgactgccccgccgcttccgcgctgcgtagagcgcgggcgtccaggaccgagatcccagcctctgaagcatgtgttcgcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttaattgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattggcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatctaatttttgctgttcaaccatgttttttgatctagctctctgattccatacattccagacttctcagtggatttgtaataaactataaataaaaatagctctcatttataaa

SEQ ID NO: 359543 - DNA, 1498 bp, Homo sapiens
tcatacgccaggtacatgatcctccggaagtctgataatgaggacattgctcgttgctgcaagatgatgcaggataaatgatgtgacatgacttgcgactgcatcgacacgactaaacgaaacgagacgatcgttgaaccgaactgtacagagcggatccagatcctgtactcggatggtataaacgaatctatcagaggtgtagcttcctgcgatgccacctattgtactaatttagcagaccgcgtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattggcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatctaatttttgctgttcaaccatgttttttgatctagctctctgattccatacattccagacttctcagtggatttgtaataaactataaataaaaatagctctcatttataaa

SEQ ID NO: 359544 - DNA, 2707 bp, Homo sapiens
agcggaggctgagtttcacgcgcgtatgctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttaattgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggatttattgtggacggatgtggatatattctgtacaggaacaacacatatggaagtggactgaagc

SEQ ID NO: 359545 - DNA, 2043 bp, Homo sapiens
agcggaggctgagtttcacgcgcgtatgctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttaattgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggtaagaacatacccttccaatatgagacatgaaataataacttgatgtagtacagcacaagcagtgccctctgtggggcaagaaaaagagttagaaaatttggttttaggccccctcagcagcttgctactcgccaccttcaagtaagtcacttaatctttgtttccctgatgggcacaaattatattagatgctttgaatacatttttcattttgagaggttgtaaaatacagaaaaatacccaaaagattcattcatatctaccacctagtatttcagaattaacattttgctatatttgttttaaatcttttgggatattaaagaaataaaattgcagatataattgcagtt

SEQ ID NO: 359546 - DNA, 290 bp, Homo sapiens
tttttttaacacagtgtcaaatccattactgtattgccatccttctcattctatacaaaaatcttcttgttttcaaactggatgatatatcttctgaggatttctttcaccttattaacttcaatctattcatctgaggatatgagtcggccctatgtgctaggcactgcaacgggccttggaatatcatgaaaataatgtcagcaccacagttagctcttacagagcactatgtaccaggcactgtgcaaatatcttcacatatattaacttccttaagccttgcaacc

SEQ ID NO: 359547 - DNA, 2096 bp, Homo sapiens
  misc_feature (1290)..(1290): n is a, c, g, or t
gcaggccggccccaccctcctgacggtcaccctggtccctgaagctgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggtgaggaagggcccctgggctgtggccctgccctcaagtcacgtgctgattttagctccagcacctcccccagttttaaggcaaggcgaggccctcaacacacacctgcggcacccggccatcagggtcctgcgggccttccgagtgcccagcgacttccacgctcgtcacgcagccacgtcccggacctacctgtaccgcctggccactggctgtcaccggcgtgatgagctgccggtgtttgaacgcaacctatgctggactctcccggcagagtgagtgtggccctgacagcggggagggggcgggcaggccggccccaccctcctgacggtcaccctggtccctgaagctgcctggatatggtcgccatgcaggaagccgcccagcacctcctcggcacacacgacttcagcgccttccagtccgctggcagcccggtgccgagccccgtgcgaacgctgcgccgggtctccgtttccccaggctggggagcggagaacagggaaggctgcttgtctctgaaaaacccctgccatgcctgatggaagaatgttggcagctactggaaaggtctcactggtgccagtggttctggtggggtggtttctgctgcccccagcactgtcccgagggccacccaccaggtggcagcttctgaccagaacctcccctattggggtgagccctgaaggggggaagaacttctgccagccccagacttctgtggcagagcagcaggtacaggactgggggtctctggcacccgcaccagccacgttcccagaccctgcaccaggaccctaggtgagggcccagggcaagcccctctgggatggccaggctacctgcccagcctccagggtcctgctgcctccttgcccaagcattgtttctctggttttaagcccctccaatgggcctcactgggggcaggagatcagccagggcccctggtggccaagctagtgggaaccaggctcgtctttaggcccaccctgtcactctcccgtccaaggccacatagtaggctgaggatggcaaacactgccccacagacacctacaggtacgtntttttccaggaagctgcggttctggaacctggagtttgagagccagtctttcctgtatagacaggtaggctctgttctggggccgtccccagggggtggggctgagggtgggcaggcccctgtgcagtcttggctctgggtcgtgggcggctctgggtcacaggtacggaggatgacggctgtgctggtgggtcacgggcggctctgggtcacaggtacggaggatgacggctgtgctggtgggtcacgggcggctctgggtcacaggtggctctgggtcacaggtacggaggatgacggctgtgctggtggccgtggggctgggggctttggcacctgcccaggtgaagacgattctggagagccaagatcccctgggcaagcaccagacacgtgtagccccagcccacggcttattcctcaagtcagtgctgtacgggaacctcggtgctgcctcctgcaccctgcaggggccacagttcgggagccacggatgaccctggacactcaagccaaagttaggccacaccaggcccaaccctgtgctggtcaagccagggcagtcacagctgcttggggcccacagcactgctgcctggtctccacagtagcctccctgcccgggtcccagcaccctggatgcccgtctctgtcccaggcgggatggggcacagtgcaggacacagccatgtacaccaagaagagagtaccaagtagtcttttgttcagcttttactggaaactgctgtctaggaccacctgccctaaccaggaataaaggcaagacagcctggaaaaaaaaaaat

SEQ ID NO: 359548 - DNA, 1181 bp, Homo sapiens
gccgcctctgacgccaccggctgggctccgccatgagttcggcgccggcctcaggctccgtgcgcgcgcgctatcttgtgtacttccagtacgtgggcaccgactttaacggggtcgcggccgtcaggggcactcagcgcgccgtcggggtccagaactacctggaggaggccgccgagcggctgaattccgtggagccggtcaggttcaccatctccagccgcacggacgccggggtccacgccctgagcaacgcggcgcacctggacgtccagcgccgctcaggccggccgcccttcccgcccgaggtcctggccgaggccctcaacacacacctgcggcacccggccatcagggtcctgcgggccttccgagtgcccagcgacttccacgctcgtcacgcagccacgtcccggacctacctgtaccgcctggccactggctgtcaccggcgtgatgagctgccggtgtttgaacgcaacctatgctggactctcccggcagactgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggaagctgcggttctggaacctggagtttgagagccagtctttcctgtatagacaggtacggaggatgacggctgtgctggtggccgtggggctgggggctttggcacctgcccaggtgaagacgattctggagagccaagatcccctgggcaagcaccagacacgtgtagccccagcccacggcttattcctcaagtcagtgctgtacgggaacctcggtgctgcctcctgcaccctgcaggggccacagttcgggagccacggatgaccctggacactcaagccaaagttaggccacaccaggcccaaccctgtgctggtcaagccagggcagtcacagctgcttggggcccacagcactgctgcctggtctccacagtagcctccctgcccgggtcccagcaccctggatgcccgtctctgtcccaggcgggatggggcacagtgcaggacacagccatgtacaccatttgagagacccgggatcctcatagagcagctcgac

SEQ ID NO: 359549 - DNA, 1448 bp, Homo sapiens
gccgcctctgacgccaccggctgggctccgccatgagttcggcgccggcctcaggctccgtgcgcgcgcgctatcttgtgtacttccagtacgtgggcaccgactttaacggggtcgcggccgtcaggggcactcagcgcgccgtcggggtccagaactacctggaggaggccgccgagcggctgaattccgtggagccggtcaggttcaccatctccagccgcacggacgccggggtccacgccctgagcaacgcggcgcacctggacgtccagcgccgctcaggccggccgcccttcccgcccgaggtcctggccgaggccctcaacacacacctgcggcacccggccatcagggtcctgcgggccttccgagtgcccagcgacttccacgctcgtcacgcagccacgtcccggacctacctgtaccgcctggccactggctgtcaccggcgtgatgagctgccggtgtttgaacgcaacctatgctggactctcccggcagagaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggaagctgcggttctggaacctggagtttgagagccagtctttcctgtatagacaggtaggctctgttctggggccgtccccagggggtggggctgagggtgggcaggcccctgtgcagtcttggctctgggtcgtgggcggctctgggtcacaggtacggaggatgacggctgtgctggtgggtcacgggcggctctgggtcacaggtacggaggatgacggctgtgctggtgggtcacgggcggctctgggtcacaggtggctctgggtcacaggtacggaggatgacggctgtgctggtggccgtggggctgggggctttggcacctgcccaggtgaagacgattctggagagccaagatcccctgggcaagcaccagacacgtgtagccccagcccacggcttattcctcaagtcagtgctgtacgggaacctcggtgctgcctcctgcaccctgcaggggccacagttcgggagccacggatgaccctggacactcaagccaaagttaggccacaccaggcccaaccctgtgctggtcaagccagggcagtcacagctgcttggggcccacagcactgctgcctggtctccacagtagcctccctgcccgggtcccagcaccctggatgcccgtctctgtcccaggcgggatggggcacagtgcaggacacagccatgtacaccaagaagagagtaccaagtagtcttttgttcagcttttactggaaactgctgtctaggaccacctgccctaaccaggaataaaggcaagacagcctggaaaaaaaaaaat

SEQ ID NO: 359550 - DNA, 1233 bp, Homo sapiens
tcggggaaggaagcggccctggcctcagacggcggcggagaccccagggcagggcgcccccggtaacctccgcccgcttctgcccgcagcggggtcgcggccgtcaggggcactcagcgcgccgtcggggtccagaactacctggaggaggccgccgagcggctgaattccgtggagccggtcaggttcaccatctccagccgcacggacgccggggtccacgccctgagcaacgcggcgcacctggacgtccagcgccgctcaggccggccgcccttcccgcccgaggtcctggccgaggccctcaacacacacctgcggcacccggccatcagggtcctgcgggccttccgagtgcccagcgacttccacgctcgtcacgcagccacgtcccggacctacctgtaccgcctggccactggctgtcaccggcgtgatgagctgccggtgtttgaacgcaacctatgctggactctcccggcagactgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggaagctgcggttctggaacctggagtttgagagccagtctttcctgtatagacaggtacggaggatgacggctgtgctggtggccgtggggctgggggctttggcacctgcccaggtgaagacgattctggagagccaagatcccctgggcaagcaccagacacgtgtagccccagcccacggcttattcctcaagtcagtgctgtacgggaacctcggtgctgcctcctgcaccctgcaggggccacagttcgggagccacggatgaccctggacactcaagccaaagttaggccacaccaggcccaaccctgtgctggtcaagccagggcagtcacagctgcttggggcccacagcactgctgcctggtctccacagtagcctccctgcccgggtcccagcaccctggatgcccgtctctgtcccaggcgggatggggcacagtgcaggacacagccatgtacaccaagaagagagtaccaagtagtcttttgttcagcttttactggaaactgctgtctaggaccacctgccctaaccaggaataaaggcaagacagcctggaaaaaaaaaaat

SEQ ID NO: 359551 - DNA, 1253 bp, Homo sapiens
gccgcctctgacgccaccggctgggctccgccatgagttcggcgccggcctcaggctccgtgcgcgcgcgctatcttgtgtacttccagtacgtgggcaccgactttaacggggtcgcggccgtcaggggcactcagcgcgccgtcggggtccagaactacctggaggaggccgccgagcggctgaattccgtggagccggtcaggttcaccatctccagccgcacggacgccggggtccacgccctgagcaacgcggcgcacctggacgtccagcgccgctcaggccggccgcccttcccgcccgaggtcctggccgaggccctcaacacacacctgcggcacccggccatcagggtcctgcgggccttccgagtgcccagcgacttccacgctcgtcacgcagccacgtcccggacctacctgtaccgcctggccactggctgtcaccggcgtgatgagctgccggtgtttgaacgcaacctatgctggactctcccggcagactgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggaagctgcggttctggaacctggagtttgagagccagtctttcctgtatagacaggtacggaggatgacggctgtgctggtggccgtggggctgggggctttggcacctgcccaggtgaagacgattctggagagccaagatcccctgggcaagcaccagacacgtgtagccccagcccacggcttattcctcaagtcagtgctgtacgggaacctcggtgctgcctcctgcaccctgcaggggccacagttcgggagccacggatgaccctggacactcaagccaaagttaggccacaccaggcccaaccctgtgctggtcaagccagggcagtcacagctgcttggggcccacagcactgctgcctggtctccacagtagcctccctgcccgggtcccagcaccctggatgcccgtctctgtcccaggcgggatggggcacagtgcaggacacagccatgtacaccaagaagagagtaccaagtagtcttttgttcagcttttactggaaactgctgtctaggaccacctgccctaaccaggaataaaggcaagacagcctggaaaaaaaaaaat

SEQ ID NO: 359552 - DNA, 1492 bp, Homo sapiens
gccgcctctgacgccaccggctgggctccgccatgagttcggcgccggcctcaggctccgtgcgcgcgcgctatcttgtgtacttccagtacgtgggcaccgactttaagaggccgccgagcggctgaattccgtggagccggtcaggttcaccatctccagccgcacggacgccggggtccacgccctgagcaacgcggcgcacctggacgtccagcgccgctcaggccggccgcccttcccgcccgaggtcctggccgaggccctcaacacacacctgcggcacccggccatcagggtcctgcgggccttccgagtgcccagcgacttccacgctcgtcacgcagccacgtcccggacctacctgtaccgcctggccactggctgtcaccggcgtgatgagctgccggtgtttgaacgcaacctatgctggactctcccggcagagtgagtgtggccctgacagcggggagggggcgggcaggccggccccaccctcctgacggtcaccctggtccctgaagctgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggaagctgcggttctggaacctggagtttgagagccagtctttcctgtatagacaggtaggctctgttctggggccgtccccagggggtggggctgagggtgggcaggcccctgtgcagtcttggctctgggtcgtgggcggctctgggtcacaggtacggaggatgacggctgtgctggtgggtcacgggcggctctgggtcacaggtacggaggatgacggctgtgctggtgggtcacgggcggctctgggtcacaggtggctctgggtcacaggtacggaggatgacggctgtgctggtggccgtggggctgggggctttggcacctgcccaggtgaagacgattctggagagccaagatcccctgggcaagcaccagacacgtgtagccccagcccacggcttattcctcaagtcagtgctgtacgggaacctcggtgctgcctcctgcaccctgcaggggccacagttcgggagccacggatgaccctggacactcaagccaaagttaggccacaccaggcccaaccctgtgctggtcaagccagggcagtcacagctgcttggggcccacagcactgctgcctggtctccacagtagcctccctgcccgggtcccagcaccctggatgcccgtctctgtcccaggcgggatggggcacagtgcaggacacagccatgtacaccaagaagagagtaccaagtagtcttttgttcagcttttactggaaactgctgtctaggaccacctgccctaaccaggaataaaggcaagacagcctggaaaaaaaaaaat

SEQ ID NO: 359553 - DNA, 1195 bp, Homo sapiens
gccgcctctgacgccaccggctgggctccgccatgagttcggcgccggcctcaggctccgtgcgcgcgcgctatcttgtgtacttccagtacgtgggcaccgactttaagaggccgccgagcggctgaattccgtggagccggtcaggttcaccatctccagccgcacggacgccggggtccacgccctgagcaacgcggcgcacctggacgtccagcgccgctcaggccggccgcccttcccgcccgaggtcctggccgaggccctcaacacacacctgcggcacccggccatcagggtcctgcgggccttccgagtgcccagcgacttccacgctcgtcacgcagccacgtcccggacctacctgtaccgcctggccactggctgtcaccggcgtgatgagctgccggtgtttgaacgcaacctatgctggactctcccggcagactgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggaagctgcggttctggaacctggagtttgagagccagtctttcctgtatagacaggtacggaggatgacggctgtgctggtggccgtggggctgggggctttggcacctgcccaggtgaagacgattctggagagccaagatcccctgggcaagcaccagacacgtgtagccccagcccacggcttattcctcaagtcagtgctgtacgggaacctcggtgctgcctcctgcaccctgcaggggccacagttcgggagccacggatgaccctggacactcaagccaaagttaggccacaccaggcccaaccctgtgctggtcaagccagggcagtcacagctgcttggggcccacagcactgctgcctggtctccacagtagcctccctgcccgggtcccagcaccctggatgcccgtctctgtcccaggcgggatggggcacagtgcaggacacagccatgtacaccaagaagagagtaccaagtagtcttttgttcagcttttactggaaactgctgtctaggaccacctgccctaaccaggaataaaggcaagacagcctggaaaaaaaaaaat

SEQ ID NO: 359554 - DNA, 365 bp, Homo sapiens
ttagaaaatccataaattggatatctcctgctcccagtaatttggatttgattatattgtttactatttggacactggggattttgtaaatccaaaagaaaggcttctcatgagggattacatgtattaatgttttagagtttgtaagagtgattttattatttgatacctattgaaatcctgggagataggtgagcaggtgtcctgaggcttagagagggtaggccgcctctgctacgtcaggtgtcacatacgttctggtctcaggacttgtgcttttccactatacagggcttccctgtaggatctgggtaaaggagttgaggggtgatctgtctggagagcagcaattatagggcccatct

SEQ ID NO: 359555 - DNA, 1771 bp, Homo sapiens
gaattcatctgtcgactgctaccacgggagttccccggagaaggatcctgcagcccgagtcccgaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatga

SEQ ID NO: 359556 - DNA, 717 bp, Homo sapiens
  misc_feature (1)..(1): n is a, c, g, or t
ncacctctttttgaacgaacaatcgtccctggggattaaaaaaatttgttccaattataactccattaccctccccggtttatccccctaaaccctctttccaaaactcaccctctgtagccaataatttcgcccccgccctatattttttttccccccccccggtatgaaccccccctgttagaaaaatgtcttatgaaattttcaccccttagagaactctttaaatctcctcgcttagagttaattttgtgcccccaatataaggtgccccccccccgcagagaattataaggttctcccttcccccaaggatatcccccgagtttatccccatttttcccccattcccgcgacccgttgtttaaaccgcgccggccccgctgcgcctatggctctatatatatataccgcgcctccccctaatatagggcgccccccttgggcaccacaggaaacctgtgggtaaccgccgtataagccttgtggccccctccgagagggagatatacccttttctaaaccgcccccttcctcccgattctcagaaaactcaattccgacctcatatttctcaaattccccacccgcgcccccctctttttttttttttgttttttttttttttttttttagcctgtcacaataaagtttattatgaaaacaggctggtgtggggacatggggacagataagtacatttaggttgggtggctc

SEQ ID NO: 359557 - DNA, 1843 bp, Homo sapiens
ggcggggcggggccggcggcgggctgcgggcgcggccggacgggagttccccggagaaggatcctgcagcccgagtcccgaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359558 - DNA, 3340 bp, Homo sapiens
tcagagtggcaaattcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttgcccagtgggcctagcatctaggaagactctagctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcacgcagcctgatagtgaacagaacccttgtgcccatacttttgccccccgagtttggcctgccctagcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatgatgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359559 - DNA, 3729 bp, Homo sapiens
tcagagtggcaaattcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttgcccagtgggcctagcatctaggaagactctagctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcacgcagcctgatagtgaacagaacccttgtgcccatacttttgccccccgagtttggcctgccctagcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatgatgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaaggtacgtacaaactccttcgtcatccacatcacatacatgccatgagggtcagtcacaggcactgtaacatacagtagaaagcatgtgtgctcttcccccttttcccatgccctgacaccagtatctcatttggaactgactgtactttctgcctcttctttttgtctggccatggggtccagctattgcagtacaaggcagacatcaatgcagtgaatgaacacgggaatgtgcccctgcactatgcctgtttttggggccaagatcaagtggcagaggtgagtactcagcccttaattcctgagatgggtaggaagtaaagtctgagccttggtgggagattttggaaccctcaacccattctgtcagtactactgtgtgacacttacaggattaagttctacatttgtgcattcatggttggttcagtgactgccagcgaggtagcagtggctctcatcataatggccttttcattccaggacgacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359560 - DNA, 1670 bp, Homo sapiens
gaattcatctgtcgactgctaccacgggagttccccggagaaggatcctgcagcccgagtcccggtgagtgcgagaggacccgcgccccctgtcacccctcacttctcctgagtcccaatcctcaggcttccccaatccaggggactcggcgccgggacgctgctatggacgacattttcactcagtgccgggagggcaacgcagtcgccgttcgcctgtggctggacaacacggagaacgacctcaaccagggctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359561 - DNA, 3822 bp, Homo sapiens
tcagagtggcaaattcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttgcccagtgggcctagcatctaggaagactctagctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcacgcagcctgatagtgaacagaacccttgtgcccatacttttgccccccgagtttggcctgccctagcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatgatgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaaggtacgtacaaactccttcgtcatccacatcacatacatgccatgagggtcagtcacaggcactgtaacatacagtagaaagcatgtgtgctcttcccccttttcccatgccctgacaccagtatctcatttggaactgactgtactttctgcctcttctttttgtctggccatggggtccagctattgcagtacaaggcagacatcaatgcagtgaatgaacacgggaatgtgcccctgcactatgcctgtttttggggccaagatcaagtggcagaggtgagtactcagcccttaattcctgagatgggtaggaagtaaagtctgagccttggtgggagattttggaaccctcaacccattctgtcagtactactgtgtgacacttacaggattaagttctacatttgtgcattcatggttggttcagtgactgccagcgaggtagcagtggctctcatcataatggccttttcattccaggacgacctggtggcaaatggggcccttgtcagcatctgtaacaagtatggagagatgcctgtggacaaagccaaggcacccctgagagagcttctccgaggtccatctccccatcccctagcttgtgtcctctcgtcccttcccacctgtcttctccctctgtaccacagcttaggttgtttttcttccctagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359562 - DNA, 3924 bp, Homo sapiens
tcagagtggcaaattcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttgcccagtgggcctagcatctaggaagactctagctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcacgcagcctgatagtgaacagaacccttgtgcccatacttttgccccccgagtttggcctgccctagcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatgatgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaaggtacgtacaaactccttcgtcatccacatcacatacatgccatgagggtcagtcacaggcactgtaacatacagtagaaagcatgtgtgctcttcccccttttcccatgccctgacaccagtatctcatttggaactgactgtactttctgcctcttctttttgtctggccatggggtccagctattgcagtacaaggcagacatcaatgcagtgaatgaacacgggaatgtgcccctgcactatgcctgtttttggggccaagatcaagtggcagaggtgagtactcagcccttaattcctgagatgggtaggaagtaaagtctgagccttggtgggagattttggaaccctcaacccattctgtcagtactactgtgtgacacttacaggattaagttctacatttgtgcattcatggttggttcagtgactgccagcgaggtagcagtggctctcatcataatggccttttcattccaggacgacctggtggcaaatggggcccttgtcagcatctgtaacaagtatggagagatgcctgtggacaaagccaaggcacccctgagagagcttctccgaggtccatctccccatcccctagcttgtgtcctctcgtcccttcccacctgtcttctccctctgtaccacagcttaggttgtttttcttccctagagcgggcagagaagatgggccagaatctcaaccgtattccatacaaggacacattctggaaggggaccacccgcactcggcccctgagtcaccactgtgggaagaagggttgtaaaaggaaataatcctggcctcttggggctgggttagggtgaagctgggtacctgacctgcccacactcttaggaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359563 - DNA, 3527 bp, Homo sapiens
tcagagtggcaaattcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttgcccagtgggcctagcatctaggaagactctagctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcacgcagcctgatagtgaacagaacccttgtgcccatacttttgccccccgagtttggcctgccctagcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatgatgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaaggtacgtacaaactccttcgtcatccacatcacatacatgccatgagggtcagtcacaggcactgtaacatacagtagaaagcatgtgtgctcttcccccttttcccatgccctgacaccagtatctcatttggaactgactgtactttctgcctcttctttttgtctggccatggggtccagctattgcagtacaaggcagacatcaatgcagtgaatgaacacgggaatgtgcccctgcactatgcctgtttttggggccaagatcaagtggcagagagcgggcagagaagatgggccagaatctcaaccgtattccatacaaggacacattctggaaggggaccacccgcactcggcccctgagtcaccactgtgggaagaagggttgtaaaaggaaataatcctggcctcttggggctgggttagggtgaagctgggtacctgacctgcccacactcttaggaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359564 - DNA, 3973 bp, Homo sapiens
tcagagtggcaaattcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttgcccagtgggcctagcatctaggaagactctagctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcacgcagcctgatagtgaacagaacccttgtgcccatacttttgccccccgagtttggcctgccctagcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatgatgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaaggtacgtacaaactccttcgtcatccacatcacatacatgccatgagggtcagtcacaggcactgtaacatacagtagaaagcatgtgtgctcttcccccttttcccatgccctgacaccagtatctcatttggaactgactgtactttctgcctcttctttttgtctggccatggggtccagctattgcagtacaaggcagacatcaatgcagtgaatgaacacgggaatgtgcccctgcactatgcctgtttttggggccaagatcaagtggcagaggtgagtactcagcccttaattcctgagatgggtaggaagtaaagtctgagccttggtgggagattttggaaccctcaacccattctgtcagtactactgtgtgacacttacaggattaagttctacatttgtgcattcatggttggttcagtgactgccagcgaggtagcagtggctctcatcataatggccttttcattccaggacgacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggcccctgagtcaccactgtgggaagaagggttgtaaaaggaaataatcctggcctcttggggctgggttagggtgaagctgggtacctgacctgcccacactcttaggaaatggaaccctgaacaaacactctggcattgacttcaaacagcttaacttcctgacgaagctcaacgagaatcactctggagaggtgacccctgcccttcttgcccttccctcactaaacccccataaattacttgctttgtacctgttttaagtttttcctccagttagtgggcaaggaagtggcagcaacatttcaagcctcctaacccctacctgtcctgcagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359565 - DNA, 1936 bp, Homo sapiens
ggcggggcggggccggcggcgggctgcgggcgcggccggacgggagttccccggagaaggatcctgcagcccgagtcccgaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgaggtccatctccccatcccctagcttgtgtcctctcgtcccttcccacctgtcttctccctctgtaccacagcttaggttgtttttcttccctagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359566 - DNA, 2126 bp, Homo sapiens
gaattcatctgtcgactgctaccacgggagttccccggagaaggatcctgcagcccgagtcccggtgagtgcgagaggacccgcgccccctgtcacccctcacttctcctgagtcccaaaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggcccctgagtcaccactgtgggaagaagggttgtaaaaggaaataatcctggcctcttggggctgggttagggtgaagctgggtacctgacctgcccacactcttaggaaatggaaccctgaacaaacactctggcattgacttcaaacagcttaacttcctgacgaagctcaacgagaatcactctggagaggtgacccctgcccttcttgcccttccctcactaaacccccataaattacttgctttgtacctgttttaagtttttcctccagttagtgggcaaggaagtggcagcaacatttcaagcctcctaacccctacctgtcctgcagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359567 - DNA, 1029 bp, Homo sapiens
ggcggggcggggccggcggcgggctgcgggcgcggccggacgggagttccccggagaaggatcctgcagcccgagtcccgtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtgggcagccactgtggagccacttcgtgggcagcgggg

SEQ ID NO: 359568 - DNA, 1030 bp, Homo sapiens
  misc_feature (911)..(912): n is a, c, g, or t
  misc_feature (919)..(919): n is a, c, g, or t
  misc_feature (921)..(921): n is a, c, g, or t
  misc_feature (925)..(925): n is a, c, g, or t
  misc_feature (927)..(928): n is a, c, g, or t
  misc_feature (937)..(937): n is a, c, g, or t
  misc_feature (942)..(942): n is a, c, g, or t
ggcggggcggggccggcggcgggctgcgggcgcggccggacgggagttccccggagaaggatcctgcagcccgagtcccgaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggatttctcgcnnccaatgngntccngnntggtggcgncagtnccctggtctcatctactctccccgggtcggttgtcccctcagtttttgagcccttttggggcccccggtggtgtgccgggggggcccc

SEQ ID NO: 359569 - DNA, 2768 bp, Homo sapiens
tcagagtggcaaattcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttgcccagtgggcctagcatctaggaagactctagctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcacgcagcctgatagtgaacagaacccttgtgcccatacttttgccccccgagtttggcctgccctagcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatgatgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaaggtacgtacaaactccttcgtcatccacatcacatacatgccatgagggtcagtcacaggcactgtaacatacagtagaaagcatgtgtgctcttcccccttttcccatgccctgacaccagtatctcatttggaactgactgtactttctgcctcttctttttgtctggccatggggtccagctattgcagtacaaggcagacatcaatgcagtgaatgaacacgggaatgtgcccctgcactatgcctgtttttggggccaagatcaagtggcagaggtgagtactcagcccttaattcctgagatgggtaggaagtaaagtctgagccttggtgggagattttggaaccctcaacccattctgtcagtactactgtgtgacacttacaggattaagttctacatttgtgcattcatggttggttcagtgactgccagcgaggtagcagtggctctcatcataatggccttttcattccaggacctgtcttctccctctgtaccacagcttaggttgtttttcttccctagagcgggcagagaagatgggccagaatctcaaccgtattccatacaaggacacattctggaaggggaccacccgcactcggccccctccttctatctgttttctcttcctcagattgatgaggacatgactgcccgaattagcatggctgatgtcaagttctctttccaatgtcctggtcgcatgtatgcacctgcctgggtagcccccgaaggtgagtgaagtcatcatgtcgggaggtaaaaaaggaccacctcagaagtagtggaagggggcagagacaggacaggcaagggggccagaacagacaagcc

SEQ ID NO: 359570 - DNA, 2284 bp, Homo sapiens
tcagagtggcaaattcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttgcccagtgggcctagcatctaggaagactctagctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcacgcagcctgatagtgaacagaacccttgtgcccatacttttgccccccgagtttggcctgccctagcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatgatgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatccccttcccccatccctaccactgtggccccaagaggggcgggctcagagctttgtcacttgccacatggtgtctcccaacatgggagggatcagccccgcctgtcacaataaagtttattatga

SEQ ID NO: 359571 - DNA, 2340 bp, Homo sapiens
tcagagtggcaaattcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttgcccagtgggcctagcatctaggaagactctagctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcacgcagcctgatagtgaacagaacccttgtgcccatacttttgccccccgagtttggcctgccctagcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatgatgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359572 - DNA, 2258 bp, Homo sapiens
tcagagtggcaaattcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttgcccagtgggcctagcatctaggaagactctagctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcacgcagcctgatagtgaacagaacccttgtgcccatacttttgccccccgagtttggcctgccctagcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatgatgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359573 - DNA, 581 bp, Homo sapiens
ggcggggcggggccggcggcgggctgcgggcgcggccggacgggagttccccggagaaggatcctgcagcccgagtcccgtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagagctgtggccccaagaggggcgggctcagagctttgtcacttgccacatggtgtctcccaacatgggagggatcagccccgcctgtcacaataaagtttattatga

SEQ ID NO: 359574 - DNA, 581 bp, Homo sapiens
gaggacacagccaggggtcatcccgcagccccgaactccttcacagacccccactagccggggacgcagctcaggccccctacccccaacacaaacacttctctcctgtagaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359575 - DNA, 271 bp, Homo sapiens
gaattcatctgtcgactgctaccacgggagttccccggagaaggatcctgcagcccgagtcccggtgagtgcgagaggacccgcgccccctgtcacccctcacttctcctgagtcccaagtaaggaacggagccaaccctggggaggacccccggtcccctctcccagagtatacggagcctgaacctccccacttcccccaactctgttcgccgatagggtctagttgcctgctctcggacatccgttcagcagacactacctcttcgtc

SEQ ID NO: 359576 - DNA, 1797 bp, Homo sapiens
ggcggggcggggccggcggcgggctgcgggcgcggccggacgggagttccccggagaaggatcctgcagcccgagtcccgtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359577 - DNA, 1874 bp, Homo sapiens
gaggacacagccaggggtcatcccgcagccccgaactccttcacagacccccactagccggggacgcagctcaggccccctacccccaacacaaacacttctctcctgtagaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359578 - DNA, 1677 bp, Homo sapiens
ggcggggcggggccggcggcgggctgcgggcgcggccggacgggagttccccggagaaggatcctgcagcccgagtcccgaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359579 - DNA, 1577 bp, Homo sapiens
  misc_feature (14)..(14): n is a, c, g, or t
  misc_feature (18)..(18): n is a, c, g, or t
  misc_feature (133)..(133): n is a, c, g, or t
tccggttggcccgnatangcttctgtacaacatcacggtgtccatgactggctgccagatgcaggggggtgtcatccccacggttcattacattgatccgtgccccccgcatgatcaacatctcaaccacagnagagcggccctctcggcaggcccagtggctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359580 - DNA, 1890 bp, Homo sapiens
ggcggggcggggccggcggcgggctgcgggcgcggccggacgggagttccccggagaaggatcctgcagcccgagtcccgtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgaggtccatctccccatcccctagcttgtgtcctctcgtcccttcccacctgtcttctccctctgtaccacagcttaggttgtttttcttccctagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359581 - DNA, 868 bp, Homo sapiens
ggcggggcggggccggcggcgggctgcgggcgcggccggacgggagttccccggagaaggatcctgcagcccgagtcccgtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtccctgctcttccttgtactccaggtcgacgcggccggcgaatttagtagtagtagtag

SEQ ID NO: 359582 - DNA, 798 bp, Homo sapiens
ggcggggcggggccggcggcgggctgcgggcgcggccggacgggagttccccggagaaggatcctgcagcccgagtcccgtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctc

SEQ ID NO: 359583 - DNA, 188 bp, Homo sapiens
ctgcagaagaagcctgaagacacaaacagacgctcagcagacatgtggagttttgcagtgcttctgtgggaactggtgacacgggaggtaccctttgctgacctctccaatatggagattggaatgaaggtgagagcacaacagcatacatttgtgttgcgggagtggttggtgatggtgaaaataac

SEQ ID NO: 359584 - DNA, 2654 bp, Homo sapiens
  misc_feature (1119)..(1119): n is a, c, g, or t
  misc_feature (1560)..(1560): n is a, c, g, or t
tttttccctctgcatataccgttacctatgtgtgagcacatgttgttctgtaacttttttaacttaacagtgtagtcaactgataattcaataatggaagtaaaggtaaaaataaactaagcctacagagatttttacatctttgctatttaatatgtgatgaacctccatattcaggaattttatttacaaacaccttatctattctttgtccttcctctttagagtggatgtaactgaaattcagatagctttagtgattgtctttgtgttgtctgcatttggaggagcaacaatgtgggactatacggtaaatctgaatatttaaatttatatttaagtacttttcaaatatttaggaaaaagtattgcattgttaattttcttcaaaaatccttggcattgtatttaattttttttttttaattggtgtatttaatatttgttccatttcttaacatttttttcttcattttataatgtgtattatcctatataccttatggcatttcctcctatgcttgagtatattgccacatagaagaagacaacctcatttccctaatactaaataaaacaaaaacaacaacaaaaaacacacattggaataactttttccagggtgaaataaaataaatattttaaaaataaatccagtaaaatgttttacatttaaaacttgtcactcaatattaggaaagtagttaatttgcatttttataatctactttgaggtgaagattcccatattaaggaatgtttttattttctgcctgcttggtgacctcagtagtttcataaaagttggctcttaggaggccactgtcataaattcaagcttttttgcaaaagaagaacatttctgaagaaacagttgtcctgttaccacaacgtaagtccaccatactggctaactgactcacactttctgctcatagtgttaagaataataataataaggatatcaatagtcaacaactaacagtcattcaatacttatgttcctaaacattcaccatctgcccctcagttttatctgcccctcagaacaatcctataaaatagatattattagtattatgctttataaataagtcttagggtgattaagtaatttgnccaaggacacatgagaagtgctggagctaggaattaaacagactgattccagactgtatgtaatcactaagctatatatctagtaaaaatagtaagtgatacaaaactaaacatagttttgtggtaaacatgatcagcagtcacactccttgttatttacctaaatgatttgaaaacttatgtccacacaaaaacctgtacacaaatgtttacagcagctttattcataattgccaaaatttgaaagcaactaagatgtccttcatcttagctggataaactaatgctaaaaagaaatgagctatcaagccatgaaaagaagttatgcgaggaacttatggagttccaagaagttatggaggaaccttaaatgtttgttactaagagaaagaagccaatctgaaaagtctgcatattgtgtgattccaactatatgacatnctttaaaaaggcaaaattatggagacagtaaaaggatcagaagttaccatgggttggaggaagaagggatgaataggtgaagcacagagaatttttagggcagtaaaactattttgtatgatactaaatggtggctacatgtcattatacattcgtcatagcacacagaatgtgtaacaccaagattgaactctaatgtaaactatgaactttgggtgataatgacgtgtcaatgtaggttcaccagttgtaacaaacgtaccacgctggtgtaggatgttgttggcagagggaggggtggctatatacttttccactcaaattttgttgcaaacctaaaaccactctaaaaaattaagtccattaaaaacacagtatgaggccaggagttcaagaccagcctgggtaacttagcaagaccttgcctctacaaaaattctgtaaaactttagccaggcatggtggcatgcacctgtagtcccagctactcaggaggctgaggcaggagggtcaactgaacccaggagttcaaggctgcaatgagccattatcatgccactgactacactcctgcctgagtgacacagcaagaccccatctttaaaaaaaaaaaaaaaaaagatttccctgtagcatttagtatcagaattgccaattatcatttgtcagtaggctccgaaatagactttgggcatgtttttaagtagtagtgatagattcttcaatacattcatattccctctcatcatgtaagagtaaatagaatcaaggatatgctactataggcccatacaagataacagagggatgctatgcgttttttgtagtaactgttcaggttgtgcccgtaagaaggtaaatgtacgggcagatcacctgaggtcaagagttaaagaccagcctggccaacatggcaaaaccctgtctctgctaaaaatacacaaattagccgggtgtggtgatgggcacctgtaatcccagctactcgggaggctgaggcaggagaatcacttgaacctgggaggcagaggttgcagtgagccaagattgggccactgcactccagccctgggcgacaagagactcgtctcaag

SEQ ID NO: 359585 - DNA, 532 bp, Homo sapiens
tttcagtctattttctaaacatagtagcctctagcttctggcaattcattgttactgttttttaaatcctttgctgcctttggaagttttcttgaacagcagttgaccaacaggtaaatatattgctagagatttaatcctggatattaactacacagatgttttgcttgcatacacatcatgatatttgttacatttatgatgcaaatcatggtgtctccctttcctgtgatgctactttttagaagctactaaattcaaatgaactatcctttttcatgtttaagtcagatgaaatcttatgagattaaacatttagtcatagttatataaacagactaagctggtttggtggattcatctttcacttatgaagaaagcagtttcaaaaaaaagtcactttaggctggtccaatggtagtcagttatctcaattgattgctcacagtcagttacaggtcaaactccttgttcttctcttttcccccctcactactgtacttggctagtctacaaaaaataataaaaattt

SEQ ID NO: 359586 - DNA, 1547 bp, Homo sapiens
ccccagccggacccctccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaattttt

SEQ ID NO: 359587 - DNA, 2261 bp, Homo sapiens
ccccagccggacccctccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcacaagcatattgactgactaatagcccaaggaaaagaggagatgaagttaggggaatctatgagtgaaggaaatccccctgtgcaggaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttatattaatccttattttttcaatttcaatatgatcacttacagtttccatcataatttttttttgcaacatagccatttcttttttaaattcattttgtgcaccagtaagtagattatcatgattcttctccaactcttccatactctaaaaacacaaaagacaagttaagttacaaaggaccacttttcatctcaggttctaaacttgtacaattaattttcaaaagtagtaatttttgaatattcaaatgctcatctatttgaaataaaaatattctaagtaatacatgaataccaaaatacctactaaaaaagaaaaaatataagacatgaataaaatgttataggaagtacaatgtagtatactttgcccaaaatgggtttcctgaactgttaaggtcaagataaaaaagactggaagtcccacatcagtaaaaaccatttctattaagctttccaaatatcaagcaataatctacttatgactaatagtgtgccatgaattcactagagggaataaaataatctatagtacaacctctttcacattatgaaaaataaaaattatgtctta

SEQ ID NO: 359588 - DNA, 2168 bp, Homo sapiens
ccccagccggacccctccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttatattaatccttattttttcaatttcaatatgatcacttacagtttccatcataatttttttttgcaacatagccatttcttttttaaattcattttgtgcaccagtaagtagattatcatgattcttctccaactcttccatactctaaaaacacaaaagacaagttaagttacaaaggaccacttttcatctcaggttctaaacttgtacaattaattttcaaaagtagtaatttttgaatattcaaatgctcatctatttgaaataaaaatattctaagtaatacatgaataccaaaatacctactaaaaaagaaaaaatataagacatgaataaaatgttataggaagtacaatgtagtatactttgcccaaaatgggtttcctgaactgttaaggtcaagataaaaaagactggaagtcccacatcagtaaaaaccatttctattaagctttccaaatatcaagcaataatctacttatgactaatagtgtgccatgaattcactagagggaataaaataatctatagtacaacctctttcacattatgaaaaataaaaattatgtctta

SEQ ID NO: 359589 - DNA, 1589 bp, Homo sapiens
agcgggacgcggcgcgccgccgaccattcttggtgtctgtcgggtgcctcgggtcatttacgagcagcgagccggccttgacgcgtccaggcatcgcccttcgcgcggcgcgcagcgcgctgagatccattccgctgccacgtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttatatt

SEQ ID NO: 359590 - DNA, 1460 bp, Homo sapiens
ccccagccggacccctccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatcttttattattattctaggctcgagttcgctcacactacagtcagtcgagtcaagcccgaacacgatatagggata

SEQ ID NO: 359591 - DNA, 1344 bp, Homo sapiens
ccccagccggacccctccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgttttcttgaacagcagttgaccaacaggtaaatatattgctagagatttaatcctggatattaactacacagatgttttgcttgcatacacatcatgatatttgttacatttatgatgcaaatcatggtgtctccctttcctgtgatgctactttttagaagctactaaattcaaatgaactatcctttttcatgtttaagtcagatgaaatcttatgagattaaacatttagtcatagttatataaacagactaagctggtttggtggattcatctttcacttatgaagaaagcagtttcaaaaaaaagtcactttaggctggtccaatggtagtcagttatctcaattgattgctcacagtcagttacaggtcaaactccttgttcttctcttttcccccctcactactgtacttggctagtctacaaaaaataataaaaattt

SEQ ID NO: 359592 - DNA, 148 bp, Homo sapiens
tcaaattatttccatgttatcctccatggtggtgttggcaagaatggatccactatagcagtaaggcaataatttcatcattcagtgtcaattttatgatacattttcttatcaccagttataaaaagattaaaatatgccaaagttc

SEQ ID NO: 359593 - DNA, 1598 bp, Homo sapiens
ccccagccggacccctccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttatatt

SEQ ID NO: 359594 - DNA, 1691 bp, Homo sapiens
ccccagccggacccctccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcacaagcatattgactgactaatagcccaaggaaaagaggagatgaagttaggggaatctatgagtgaaggaaatccccctgtgcaggaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttatatt

SEQ ID NO: 359595 - DNA, 2058 bp, Homo sapiens
ccccagccggacccctccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcacaagcatattgactgactaatagcccaaggaaaagaggagatgaagttaggggaatctatgagtgaaggaaatccccctgtgcaggaggctagtataccatcaataaggttatatttgaatataaaacataaaccctgtagatttcattgtgtcttatttcagttatgaagcccccgttgtatcatcattttttatcacagatgttctcagaattgtctacatattaattagaaacaagactaaagaaatgtcaatcctgaggacaacagtgaacccctgtaattctaagtagcagtttgtctctgagacttatcagacacagggttttcactgccaaaggattacataaatattcagaacataaaggattttagccatcttgagggtgcttactttgactgctaaaaactgaaaagtgattcaatactgcttaagtgcatggcttataatgtaattattgaatcaagttatgttctaagaaattttttatactaatcatttttcaagaggcatattagtatgttataaaatacttgcttttagtatactagaatttaaaagggctacaggaattttttaaataaaatttgtatttaataaaaggaatttgttgtaccagttcagaa

SEQ ID NO: 359596 - DNA, 1640 bp, Homo sapiens
ccccagccggacccctccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcacaagcatattgactgactaatagcccaaggaaaagaggagatgaagttaggggaatctatgagtgaaggaaatccccctgtgcaggaggttcaagttctttcttcaaagagtcatcagaataacatggattgaagagacttccgaacacttgctatctcttgctgctgctgtttcatggaaggagatattaaacatttgtttaattttt

SEQ ID NO: 359597 - DNA, 1678 bp, Homo sapiens
ccccagccggacccctccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttatattaaaaaaaaaacaacagaaagaaaaaacgacaatgacacaagaagaacaaaaacaaagagagaacaaaaaaaagagagaac

SEQ ID NO: 359598 - DNA, 1489 bp, Homo sapiens
tccacctcccccctccccccccacccctcactccacccccccactcccaccaccccccccccaccctctccctccacctctccctccccccacccccacccaccccctccctccctcccccccccccccccctcacgcccccatccccccaccccccccccccccctcccccccgcgctccctcacccccctcaaccaacccctcacccccccgcactccccccactccaccagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttatatt

SEQ ID NO: 359599 - DNA, 1625 bp, Homo sapiens
ccccagccggacccctccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgttttcttgaacagcagttgaccaacagattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttatatt

SEQ ID NO: 359600 - DNA, 827 bp, Homo sapiens
gctgggaccatctgctgggtccctcaggtgctatgcacctgccgggcatgtgatgccgtttatctcactcagtcttcacaaacccatgagagatgcagtattattccctttatgcagatgaagaaactggggttaattgaggttgagtaccttgcccagggtcacacagtaagcgatagaacctggattcaaccccagtctggagccccatggtgcgtcacacgtatgatcatcctctgtcttgtatgtcttgtttggaaagggttggaaactcttgacatgaggaatggttgttattaatagcaggttttgaggaaaaccttctagaagagtcccagtatggggaagtggcagaggagacccctgcctccaacaaccagaatgccaggatgctcgagggaagacagacacctgcctccaccctggagcaagatgccactgactaccgcctccgaagcctgcggaaactcctggctcagccccgggagggcctgctggcccccttctccaagcggaactccacagcgtccttcccagggaggaccagccacattccagtgcagcagccagagaagaggaagcaaaaacccagccctgagcccagccaagattcacctcattccgacaagtggcctcctgggcaccctgtgaagaacctgcctcagatgagggggcccaggcccaggcccgctggtgacagccccaggaagactcagtggctgaaccaggtggagtcgtacatcgcagagcagagacggggtgacaggatgcggcctcaggcccctggaaggggctggcatggggaggaggaagtggtggcggccgca

SEQ ID NO: 359601 - DNA, 429 bp, Homo sapiens
gctgggaccatctgctgggtccctcaggtgctatgcacctgccgggcatgtgatgccgtttatctcactcagtcttcacaaacccatgagagatgcagtattattccctttatgcagatgaagaaactggggttaattgaggttgagtaccttgcccagggtcacacagtaagcgatagaacctggattcaaccccagtctggagccccatggtgcgtcacacgtatgatcatcctctgtcttgtatgtcttgtttggaaagggaggggaagggaaatctaccaggcttggtggcatgtgcctgtagtcccagatactcaggaggctgaggcgggaggatcacctgagcctggggaggttgagtctgcagtaagccgtgatcatgccaccacactccagcctgggccacagagtgagagcttgtcgcca

SEQ ID NO: 359602 - DNA, 570 bp, Homo sapiens
atatattgtttttgttttccagagagattagtttataaaacaaagcaaacaaaaccctacagaagggtttgtattctggtcttgtagagcagcaaggaagggggctctcaggagtctgtggcactttgcagcctggtttaagggtaaggaccccggggacagagtgctggaggcagctactctaggtcagtcagatcccaggcagtgcagaggcaaaaaattggggtttctgaacacctccattactcattagtgaatttgtgcagagtaatgcgtacttgtaaagaaatctgttgaactggtgagaggaagccccagcaggagaatttggtgaccaaaactgtccccagcattagaggggtttcacattttcatctcctgaaggaatggctgctgtgactccctggctggattctaggggcaccctgatcttcacagccatcctcgccaacttatgtgtagtccttttcttcttgagccaagaaaagattggtagcatcttttcagacatattaaatcaagacacgacatttttaaaataaaaatatttttatagacacatatatggca

SEQ ID NO: 359603 - DNA, 544 bp, Homo sapiens
tatgttattccctatagaatctggagcaggagcctcagtctcctatcaaaaggagaagaacctgaagaaaacacttctcttccttctctctgcctaggggcagtgaccttggattcaaccaccatcatcccttccagacaccagaggggggagtcccacaaggcagaaggtgcccctgtgacccatccacttctcttccatgttctttacctccttgctcaggaagccataaagttgagctgagtggaaggtgaatttcattgcaaagtttacacaggctctgctgacaggttcatgaaaacactactgaatatgttacataccaccaaggctcacagcacatcctgtgttggaagtgatacttttccattaccagtaaacctccttttgtcctaggagctcactgaacagctaaaatcaggtgatatttttatgtggaacatgcaacgtattaagtccttttgctcagtgacccaaaaaggaactaaacggtacccagactagaaatcaatgtcaaattattcaaataaattccacttaaaga

SEQ ID NO: 359604 - DNA, 2442 bp, Homo sapiens
  misc_feature (80)..(80): n is a, c, g, or t
  misc_feature (156)..(156): n is a, c, g, or t
  misc_feature (164)..(164): n is a, c, g, or t
  misc_feature (204)..(204): n is a, c, g, or t
cccctgtatgtgggtggggtgggcgtacggaggggcgaaaaacagagggcggtcgtccctaggccccgtcttcgacttgngacacgctgggcatctcgggttataaaaggtggggctgagacgagtgtgtgtcaatttcgaacccccgactccggngctccgcnggggaaggggctgggggtcagctttgtaaagggacctaangctcctccaccctaaggcttcccctcccccaatatcccgaacagtcgcggggtggggacagtgagagcccagaaggttcgagaatgtctcagcctgtgtttcagaagcacttgaattgttggcctctgcccagtgggttcccttggccacgaaccccactccttttctggcctcagttttccgtctgtggcaagagggaggctctgtgtcaataccgaacacgcttaatttctgcaagtctcaggaagggtataataggataggatataaattacgttctctccactccccagcacctaatactgtgtggcatgctgtaggtatttaataaatacgtgttcaatgaatttatcctcccaggaatcccttaagagaggggaattttaggccaggtgccgttgatcacgcctgtaatccaaacactgggaggctgaggcgggtggatcgcttgagcccaagagttcgagaccagcctgggcaacccagggagacccccccctcgtctctacagaaacttaaaaagttagccgggcatggtggcgcactcctgtagtcgcagctgcttgggaggctgaggcaggaggatcactggagcccggaaggcggaagttgcagtgagctgaaatcgtgccactgcactccatcctggacagcagagcgagactctgtctcaaaaaaaaaaagtaaattaaagagaggaattttagttctatgttacaggtgagaaaactgaggctgggactggggtgggggcaggtcagtagcttcaagtctggactgcaggtgacaggggtaactggaacctgggtttgtcggcagctttccaacgtctctgcctgctcgacaaagcagaggcaagagtgacattttgagacgcctaccaggcctgtacaccagattccagtcccgaaatagcctgctgtgggggttgggtgagcctgtatttcaccctggggactgggaaggtgttcagaatctaggagctgcggggccgggtgcggtggctcctgcctgtaatctcagcactttgggaggctggggcgggccgatcccctgaggttaggagttcgagaccagcctggccaacatggtgaaaatacaaaaattagctgggcgtggtgtaagaatccaggagccgcagggttttccttggagtgctgcgagggctgtgggtgagggtggtgggcacagggagtgggtggggaccttacgtgtgctgttcttctcctaatccagttctcctggttttcccccgtccccgtctctcgtatttgtggtctccttgtctcctctctcccctttttcccctcccccttctctgtctcttgcttggtgttggttttctgtgtgtctctgtgtgtccccgcgccaccccctgtgctgtgtcccaaaactctgcctggctggtgcctgtcttctctcttgagggcatctgtcacctcttctgcttggtcatctgtgttcctctttatttcttcctggccccatcttgctctctccccacaccgcctgtgtctaccctcctctccccgatcccccacttctccctctctcccctgggccccaatgtcttggactctcctaccagtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaa

SEQ ID NO: 359605 - DNA, 476 bp, Homo sapiens
  misc_feature (53)..(53): n is a, c, g, or t
agagagagagagagagagagagagagagagagagagagagaaagccgccttgntcagggctaatgcgccctgaaggcagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaa

SEQ ID NO: 359606 - DNA, 1073 bp, Homo sapiens
ctgtccgtcctgcctggttttggggctagcatggggttggggctgaggttggtgtctcggtcccagctcaccccttccctcttcctcccctccctagaaaggcgatggctacgtggacacagaaagcaagtttctgaagttggtggccgccatcaaagccgccttggctcagggctaatgcgccctgaaggcagaggtgagggggcccactagacagggacaccaccctttggatcttctccctgccccatgctctgactccttggcccagggtggagagcctgggagatgggggggacatcacgtgtgtccccagagcgagcgggataaagttagacccggttggtggaggacaacaactgagatggggtcagaggtgtgcagggtgacagctgagatggtgatgggtcagagatatgcaggatgacagctgagatggggtcaaaggtatgcaggatgacagctgagatggtgatgggtcagaggtgtgcaggatgacagctgagatggtgatgggtcaaaggtatgcaggatgacggctgagatggtgatgggtcagaggtgtgcaggatgacggctgagatgctgatgagtcagaggtgtgcaggatgatggctgagatggtgatgggtcagaggtgtgcaggatgacggctgagatggtgatgggtcagagatgtgcaggatgacagctgagatggggtcagaggtgtgcaggatgacagctgagatagggtcagaggtatgcaggatgacagctgagatggggtatgcaagatgacagctgagttggtggtggggtcagagggctgccctaaaacagctctcctggtttgggaatgaaaagtgctagcaacccaacggttcagaatccggaactctaggtctttgtcccattgccaagaaacagttcccaacccagcaggtcatgtgacagcgtccggccaagttcccagcatgttttgagacagaatttccttgctccacaatttcgagtaggtcactaattatcaccgggctctgaacctgagaattagttctaggaatattccagacctgatccagctccagaaa

SEQ ID NO: 359607 - DNA, 193 bp, Homo sapiens
  misc_feature (16)..(16): n is a, c, g, or t
ctcgaattcaagcttntaacgatgtacggggacatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaa

SEQ ID NO: 359608 - DNA, 868 bp, Homo sapiens
cgggctggcgggtcgcgggttccttatcctccgccttggcgcctctccgcccaccgcccaccgcccctccctggcattggttggcgccagggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaa

SEQ ID NO: 359609 - DNA, 1499 bp, Homo sapiens
cgggctggcgggtcgcgggttccttatcctccgccttggcgcctctccgcccaccgcccaccgcccctccctggcattggttggcgccagggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaaaaaaacaacaacacaacacaacaaaactccagaaaggcattctaatcgccggggtcgcggaaacaccaccggtacctacacatggcgcccttgggccataagctggttccttggaccacagtcttccttgggtccaacggcgctggcaacactctctgccgggccccccccatattaagagaagctacgatataacatttcggagaaagcccagcgggttaccctgcttagaaagacgacgacgagcaaacaccagcagagagcccgaccagacgaaaaaggaaagtgccaaggagatacccaacctgagaaaacccacaaaacagggacaccggcgacccggcgtcgaccacacgaacgacaaaaaaaacaaccaaccaccagcagaagagcaaaagagtaagaaaacgaaaatcaaagaaaaggacgagaaaaagtaaaaaaaagagaacagagggaaaagagagggggagcgagaaagacgacagcaacaagaagacaaacgaaaagaaggaatggagagcacaaccaacagggaaaaaaaggaggagagacgcagaaagaaaacgagagggagaacgggaacacgaacaatgagcgaactac

SEQ ID NO: 359610 - DNA, 946 bp, Homo sapiens
cgggctggcgggtcgcgggttccttatcctccgccttggcgcctctccgcccaccgcccaccgcccctccctggcattggttggcgccagggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaaaaacacacagaaaaaaaaaaactccgaagacattacatatgtagaggtagcga

SEQ ID NO: 359611 - DNA, 1223 bp, Homo sapiens
cgggctggcgggtcgcgggttccttatcctccgccttggcgcctctccgcccaccgcccaccgcccctccctggcattggttggcgccagggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaaaaaaaaaaaaaaaaaaaaaaaaaaaaaaaaaaaaaaaaaaaaaaaaaaaaaaaaaaaaaaaaaaaaaaaaaaaaaaaaaaaaaaagcggagcgggcgggcgcccaacaatagaataatgcacgccaccgcggggcggcacccaccgatccaacgaaacaccaccccaatcatttcagtcaccagaagggcgcccaccccaacagagccgccgtgtctccaccccccatcaccaggcggccccgacctccaaccactccagccacgtggaaaaccaccccctcacgcgcgcgccctctgcgccaagcacaccccccctccgtcggggggcc

SEQ ID NO: 359612 - DNA, 860 bp, Homo sapiens
cgggctggcgggtcgcgggttccttatcctccgccttggcgcctctccgcccaccgcccaccgcccctccctggcattggttggcgccagggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaaccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaa

SEQ ID NO: 359613 - DNA, 779 bp, Homo sapiens
cgggctggcgggtcgcgggttccttatcctccgccttggcgcctctccgcccaccgcccaccgcccctccctggcattggttggcgccagggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaa

SEQ ID NO: 359614 - DNA, 420 bp, Homo sapiens
ctccccgccgacagcacaggtttcccaggacaagaccctgactcaccccagcatggaaactaccaggaggagggtcccccatcctactatgacaaccaggacttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaa

SEQ ID NO: 359615 - DNA, 1373 bp, Homo sapiens
cgggctggcgggtcgcgggttccttatcctccgccttggcgcctctccgcccaccgcccaccgcccctccctggcattggttggcgccagggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagaggtgagggggcccactagacagggacaccaccctttggatcttctccctgccccatgctctgactccttggcccagggtggagagcctgggagatgggggggacatcacgtgtgtccccagagcgagcgggataaagttagacccggttggtggaggacaacaactgagatggggtcagaggtgtgcagggtgacagctgagatggtgatgggtcagagatatgcaggatgacagctgagatggggtcaaaggtatgcaggatgacagctgagatggtgatgggtcagaggtgtgcaggatgacagctgagatggtgatgggtcaaaggtatgcaggatgacggctgagatggtgatgggtcagaggtgtgcaggatgacggctgagatgctgatgagtcagaggtgtgcaggatgatggctgagatggtgatgggtcagaggtgtgcaggatgacggctgagatggtgatgggtcagagatgtgcaggatgacagctgagatggggtcagaggtgtgcaggatgacagctgagatagggtcagaggtatgcaggatgacagctgagatggggtatgcaagatgacagctgagttggtggtggggtcagagggctgccctaaaacagctctcctggtttgggaatgaaaagtgctagcaacccaacggttcagaatccggaactctaggtctttgtcccattgccaagaaacagttcccaacccagcaggtcatgtgacagcgtccggccaagttcccagcatgttttgagacagaatttccttgctccacaatttcgagtaggtcactaattatcaccgggctctgaacctgagaattagttctaggaatattccagacctgatccagctccagaaa

SEQ ID NO: 359616 - DNA, 1873 bp, Homo sapiens
  misc_feature (80)..(80): n is a, c, g, or t
  misc_feature (156)..(156): n is a, c, g, or t
  misc_feature (164)..(164): n is a, c, g, or t
  misc_feature (204)..(204): n is a, c, g, or t
  misc_feature (1865)..(1865): n is a, c, g, or t
cccctgtatgtgggtggggtgggcgtacggaggggcgaaaaacagagggcggtcgtccctaggccccgtcttcgacttgngacacgctgggcatctcgggttataaaaggtggggctgagacgagtgtgtgtcaatttcgaacccccgactccggngctccgcnggggaaggggctgggggtcagctttgtaaagggacctaangctcctccaccctaaggcttcccctcccccaatatcccgaacagtcgcggggtggggacagtgagagcccagaaggttcgagaatgtctcagcctgtgtttcagaagcacttgaattgttggcctctgcccagtgggttcccttggccacgaaccccactccttttctggcctcagttttccgtctgtggcaagagggaggctctgtgtcaataccgaacacgcttaatttctgcaagtctcaggaagggtataataggataggatataaattacgttctctccactccccagcacctaatactgtgtggcatgctgtaggtatttaataaatacgtgttcaatgaatttatcctcccaggaatcccttaagagaggggaattttaggccaggtgccgttgatcacgcctgtaatccaaacactgggaggctgaggcgggtggatcgcttgagcccaagagttcgagaccagcctgggcaacccagggagacccccccctcgtctctacagaaacttaaaaagttagccgggcatggtggcgcactcctgtagtcgcagctgcttgggaggctgaggcaggaggatcactggagcccggaaggcggaagttgcagtgagctgaaatcgtgccactgcactccatcctggacagcagagcgagactctgtctcaaaaaaaaaaagtaaattaaagagaggaattttagttctatgttacaggtgagaaaactgaggctgggactggggtgggggcaggtcagtagcttcaagtctggactgcaggtgacaggggtaactggaacctgggtttgtcggcagctttccaacgtctctgcctgctcgacaaagcagaggcaagagtgacattttgagacgcctaccaggcctgtacaccagattccagtcccgaaatagcctgctgtgggggttgggtgagcctgtatttcaccctggggactgggaaggtgttcagaatctaggagctgcggggccgggtgcggtggctcctgcctgtaatctcagcactttgggaggctggggcgggccgatcccctgaggttaggagttcgagaccagcctggccaacatggtgaaaatacaaaaattagctgggcgtggtgtaagaatccaggagccgcagggttttccttggagtgctgcgagggctgtgggtgagggtggtgggcacagggagtgggtggggaccttacgtgtgctgttcttctcctaatccagttctcctggttttcccccgtccccgtctctcgtatttgtggtctccttgtctcctctctcccctttttcccctcccccttctctgtctcttgcttggtgttggttttctgtgtgtctctgtgtgtccccgcgccaccccctgtgctgtgtcccaaaactctgcctggctggtgcctgtcttctctcttgagggcatctgtcacctcttctgcttggtcatctgtgttcctctttatttcttcctggccccatcttgctctctccccacaccgcctgtgtctaccctcctctccccgatcccccacttctccctctctcccctgggccccaatgtcttggactctcctaccagtggcgcttgaggctacaagtccaagtggactgcaggtgacaggggtaactgggaacctggggtttgtcggcanctttccaa

SEQ ID NO: 359617 - DNA, 893 bp, Homo sapiens
cgggctggcgggtcgcgggttccttatcctccgccttggcgcctctccgcccaccgcccaccgcccctccctggcattggttggcgccagggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaa

SEQ ID NO: 359618 - DNA, 1574 bp, Homo sapiens
  misc_feature (80)..(80): n is a, c, g, or t
  misc_feature (156)..(156): n is a, c, g, or t
  misc_feature (164)..(164): n is a, c, g, or t
  misc_feature (204)..(204): n is a, c, g, or t
cccctgtatgtgggtggggtgggcgtacggaggggcgaaaaacagagggcggtcgtccctaggccccgtcttcgacttgngacacgctgggcatctcgggttataaaaggtggggctgagacgagtgtgtgtcaatttcgaacccccgactccggngctccgcnggggaaggggctgggggtcagctttgtaaagggacctaangctcctccaccctaaggcttcccctcccccaatatcccgaacagtcgcggggtggggacagtgagagcccagaaggttcgagaatgtctcagcctgtgtttcagaagcacttgaattgttggcctctgcccagtgggttcccttggccacgaaccccactccttttctggcctcagttttccgtctgtggcaagagggaggctctgtgtcaataccgaacacgcttaatttctgcaagtctcaggaagggtataataggataggatataaattacgttctctccactccccagcacctaatactgtgtggcatgctgtaggtatttaataaatacgtgttcaatgaatttatcctcccaggaatcccttaagagaggggaattttaggccaggtgccgttgatcacgcctgtaatccaaacactgggaggctgaggcgggtggatcgcttgagcccaagagttcgagaccagcctgggcaacccagggagacccccccctcgtctctacagaaacttaaaaagttagccgggcatggtggcgcactcctgtagtcgcagctgcttgggaggctgaggcaggaggatcactggagcccggaaggcggaagttgcagtgagctgaaatcgtgccactgcactccatcctggacagcagagcgagactctgtctcaaaaaaaaaaagtaaattaaagagaggaattttagttctatgttacagtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaa

SEQ ID NO: 359619 - DNA, 2525 bp, Homo sapiens
  misc_feature (80)..(80): n is a, c, g, or t
  misc_feature (156)..(156): n is a, c, g, or t
  misc_feature (164)..(164): n is a, c, g, or t
  misc_feature (204)..(204): n is a, c, g, or t
cccctgtatgtgggtggggtgggcgtacggaggggcgaaaaacagagggcggtcgtccctaggccccgtcttcgacttgngacacgctgggcatctcgggttataaaaggtggggctgagacgagtgtgtgtcaatttcgaacccccgactccggngctccgcnggggaaggggctgggggtcagctttgtaaagggacctaangctcctccaccctaaggcttcccctcccccaatatcccgaacagtcgcggggtggggacagtgagagcccagaaggttcgagaatgtctcagcctgtgtttcagaagcacttgaattgttggcctctgcccagtgggttcccttggccacgaaccccactccttttctggcctcagttttccgtctgtggcaagagggaggctctgtgtcaataccgaacacgcttaatttctgcaagtctcaggaagggtataataggataggatataaattacgttctctccactccccagcacctaatactgtgtggcatgctgtaggtatttaataaatacgtgttcaatgaatttatcctcccaggaatcccttaagagaggggaattttaggccaggtgccgttgatcacgcctgtaatccaaacactgggaggctgaggcgggtggatcgcttgagcccaagagttcgagaccagcctgggcaacccagggagacccccccctcgtctctacagaaacttaaaaagttagccgggcatggtggcgcactcctgtagtcgcagctgcttgggaggctgaggcaggaggatcactggagcccggaaggcggaagttgcagtgagctgaaatcgtgccactgcactccatcctggacagcagagcgagactctgtctcaaaaaaaaaaagtaaattaaagagaggaattttagttctatgttacaggtgagaaaactgaggctgggactggggtgggggcaggtcagtagcttcaagtctggactgcaggtgacaggggtaactggaacctgggtttgtcggcagctttccaacgtctctgcctgctcgacaaagcagaggcaagagtgacattttgagacgcctaccaggcctgtacaccagattccagtcccgaaatagcctgctgtgggggttgggtgagcctgtatttcaccctggggactgggaaggtgttcagaatctaggagctgcggggccgggtgcggtggctcctgcctgtaatctcagcactttgggaggctggggcgggccgatcccctgaggttaggagttcgagaccagcctggccaacatggtgaaaatacaaaaattagctgggcgtggtgtaagaatccaggagccgcagggttttccttggagtgctgcgagggctgtgggtgagggtggtgggcacagggagtgggtggggaccttacgtgtgctgttcttctcctaatccagttctcctggttttcccccgtccccgtctctcgtatttgtggtctccttgtctcctctctcccctttttcccctcccccttctctgtctcttgcttggtgttggttttctgtgtgtctctgtgtgtccccgcgccaccccctgtgctgtgtcccaaaactctgcctggctggtgcctgtcttctctcttgagggcatctgtcacctcttctgcttggtcatctgtgttcctctttatttcttcctggccccatcttgctctctccccacaccgcctgtgtctaccctcctctccccgatcccccacttctccctctctcccctgggccccaatgtcttggactctcctaccagtggcgcttgaggctacaagtccaagtatcttcagctcaagaagaagttagaagatgagttccccggccgcctggacatcgtgagtcttgggatggggagaaagacttgagcacagccactgtgtcggtccgttaggcctggatggcactgcaggggggttagtgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaa

SEQ ID NO: 359620 - DNA, 3048 bp, Homo sapiens
  misc_feature (80)..(80): n is a, c, g, or t
  misc_feature (156)..(156): n is a, c, g, or t
  misc_feature (164)..(164): n is a, c, g, or t
  misc_feature (204)..(204): n is a, c, g, or t
cccctgtatgtgggtggggtgggcgtacggaggggcgaaaaacagagggcggtcgtccctaggccccgtcttcgacttgngacacgctgggcatctcgggttataaaaggtggggctgagacgagtgtgtgtcaatttcgaacccccgactccggngctccgcnggggaaggggctgggggtcagctttgtaaagggacctaangctcctccaccctaaggcttcccctcccccaatatcccgaacagtcgcggggtggggacagtgagagcccagaaggttcgagaatgtctcagcctgtgtttcagaagcacttgaattgttggcctctgcccagtgggttcccttggccacgaaccccactccttttctggcctcagttttccgtctgtggcaagagggaggctctgtgtcaataccgaacacgcttaatttctgcaagtctcaggaagggtataataggataggatataaattacgttctctccactccccagcacctaatactgtgtggcatgctgtaggtatttaataaatacgtgttcaatgaatttatcctcccaggaatcccttaagagaggggaattttaggccaggtgccgttgatcacgcctgtaatccaaacactgggaggctgaggcgggtggatcgcttgagcccaagagttcgagaccagcctgggcaacccagggagacccccccctcgtctctacagaaacttaaaaagttagccgggcatggtggcgcactcctgtagtcgcagctgcttgggaggctgaggcaggaggatcactggagcccggaaggcggaagttgcagtgagctgaaatcgtgccactgcactccatcctggacagcagagcgagactctgtctcaaaaaaaaaaagtaaattaaagagaggaattttagttctatgttacaggtgagaaaactgaggctgggactggggtgggggcaggtcagtagcttcaagtctggactgcaggtgacaggggtaactggaacctgggtttgtcggcagctttccaacgtctctgcctgctcgacaaagcagaggcaagagtgacattttgagacgcctaccaggcctgtacaccagattccagtcccgaaatagcctgctgtgggggttgggtgagcctgtatttcaccctggggactgggaaggtgttcagaatctaggagctgcggggccgggtgcggtggctcctgcctgtaatctcagcactttgggaggctggggcgggccgatcccctgaggttaggagttcgagaccagcctggccaacatggtgaaaatacaaaaattagctgggcgtggtgtaagaatccaggagccgcagggttttccttggagtgctgcgagggctgtgggtgagggtggtgggcacagggagtgggtggggaccttacgtgtgctgttcttctcctaatccagttctcctggttttcccccgtccccgtctctcgtatttgtggtctccttgtctcctctctcccctttttcccctcccccttctctgtctcttgcttggtgttggttttctgtgtgtctctgtgtgtccccgcgccaccccctgtgctgtgtcccaaaactctgcctggctggtgcctgtcttctctcttgagggcatctgtcacctcttctgcttggtcatctgtgttcctctttatttcttcctggccccatcttgctctctccccacaccgcctgtgtctaccctcctctccccgatcccccacttctccctctctcccctgggccccaatgtcttggactctcctaccagtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaaaaaaacaacaacacaacacaacaaaactccagaaaggcattctaatcgccggggtcgcggaaacaccaccggtacctacacatggcgcccttgggccataagctggttccttggaccacagtcttccttgggtccaacggcgctggcaacactctctgccgggccccccccatattaagagaagctacgatataacatttcggagaaagcccagcgggttaccctgcttagaaagacgacgacgagcaaacaccagcagagagcccgaccagacgaaaaaggaaagtgccaaggagatacccaacctgagaaaacccacaaaacagggacaccggcgacccggcgtcgaccacacgaacgacaaaaaaaacaaccaaccaccagcagaagagcaaaagagtaagaaaacgaaaatcaaagaaaaggacgagaaaaagtaaaaaaaagagaacagagggaaaagagagggggagcgagaaagacgacagcaacaagaagacaaacgaaaagaaggaatggagagcacaaccaacagggaaaaaaaggaggagagacgcagaaagaaaacgagagggagaacgggaacacgaacaatgagcgaactac

SEQ ID NO: 359621 - DNA, 777 bp, Homo sapiens
cgggctggcgggtcgcgggttccttatcctccgccttggcgcctctccgcccaccgcccaccgcccctccctggcattggttggcgccagggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaa

SEQ ID NO: 359622 - DNA, 2209 bp, Homo sapiens
  misc_feature (80)..(80): n is a, c, g, or t
  misc_feature (156)..(156): n is a, c, g, or t
  misc_feature (164)..(164): n is a, c, g, or t
  misc_feature (204)..(204): n is a, c, g, or t
cccctgtatgtgggtggggtgggcgtacggaggggcgaaaaacagagggcggtcgtccctaggccccgtcttcgacttgngacacgctgggcatctcgggttataaaaggtggggctgagacgagtgtgtgtcaatttcgaacccccgactccggngctccgcnggggaaggggctgggggtcagctttgtaaagggacctaangctcctccaccctaaggcttcccctcccccaatatcccgaacagtcgcggggtggggacagtgagagcccagaaggttcgagaatgtctcagcctgtgtttcagaagcacttgaattgttggcctctgcccagtgggttcccttggccacgaaccccactccttttctggcctcagttttccgtctgtggcaagagggaggctctgtgtcaataccgaacacgcttaatttctgcaagtctcaggaagggtataataggataggatataaattacgttctctccactccccagcacctaatactgtgtggcatgctgtaggtatttaataaatacgtgttcaatgaatttatcctcccaggaatcccttaagagaggggaattttaggccaggtgccgttgatcacgcctgtaatccaaacactgggaggctgaggcgggtggatcgcttgagcccaagagttcgagaccagcctgggcaacccagggagacccccccctcgtctctacagaaacttaaaaagttagccgggcatggtggcgcactcctgtagtcgcagctgcttgggaggctgaggcaggaggatcactggagcccggaaggcggaagttgcagtgagctgaaatcgtgccactgcactccatcctggacagcagagcgagactctgtctcaaaaaaaaaaagtaaattaaagagaggaattttagttctatgttacaggtgagaaaactgaggctgggactggggtgggggcaggtcagtagcttcaagtctggactgcaggtgacaggggtaactggaacctgggtttgtcggcagctttccaacgtctctgcctgctcgacaaagcagaggcaagagtgacattttgagacgcctaccaggcctgtacaccagattccagtcccgaaatagcctgctgtgggggttgggtgagcctgtatttcaccctggggactgggaaggtgttcagaatctaggagctgcggggccgggtgcggtggctcctgcctgtaatctcagcactttgggaggctggggcgggccgatcccctgaggttaggagttcgagaccagcctggccaacatggtgaaaatacaaaaattagctgggcgtggtgtaagaatccaggagccgcagggttttccttggagtgctgcgagggctgtgggtgagggtggtgggcacagggagtgggtggggaccttacgtgtgctgttcttctcctaatccagttctcctggttttcccccgtccccgtctctcgtatttgtggtctccttgtctcctctctcccctttttcccctcccccttctctgtctcttgcttggtgttggttttctgtgtgtctctgtgtgtccccgcgccaccccctgtgctgtgtcccaaaactctgcctggctggtgcctgtcttctctcttgagggcatctgtcacctcttctgcttggtcatctgtgttcctctttatttcttcctggccccatcttgctctctccccacaccgcctgtgtctaccctcctctccccgatcccccacttctccctctctcccctgggccccaatgtcttggactctcctaccagtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagagagggacaaagatgaatagagaagtgggctggggtcaggccgacaggattgaggactcgaccttggtggagaagaaagagagaccggggagtgagttcagggctagaactggagatggacagggaaagatggaggacacagggggtctgcagcagacggcaggcagagggtgagggtgacagagagactcttggacagacagaggctgggcaggtgagacctggtactgtcgggcta

SEQ ID NO: 359623 - DNA, 1726 bp, Homo sapiens
tccgcggtgccggccgacccggaagcatgtctgtccctagcggaggcgcgggtgccgtgctgagagcgcctgcctgtgcgccccgagcggggctgggactcttccaagatgcccacgttcgcacagagaccccggatcgcggaagctcgcgtctcgaaaggcggtctcacgccctgcccgtcctgggttcacggtttttcatcacctgcggctgtcctgcgatcgaccacagctgtgcaggaggggcaggaggtatctgttgctgcagttaccggaacctttgccaggactagtacaggaccacgggctggtagctcagggatgtctcgtctgtgagttacagctgcacgctctccaggaaagaaggaatttcctcttctctggaaaccccaccacacagctggtttctcattggtgctgcttgcccattccctgagctgtgactgccagaggagtgggaggttggtggtgcctccagcccatcaggggcaggccctgggaccgcctgggaacaggaggactatggcacaaaccgagtgagtgatgggagcaacccgcagggctctgccacatccctgtcttccttcactgacatgaaacgcagaaaaggcagctttgccacaacacaggagcacgcaccgaatgtggccgcccagggctctgtccttgaccctgttgtccaggactgtttaccaagggctgacaggcactgagtgccccgtgcacctggccagacactgcactcatgcagcggaaaggacagtgaacgagactttgtccctggcctccaaaggcttagggcgtagtggctgtcatgaggcacagtgacaagggccaggagggggacctcttagggggccatgcagtgatggaagccagaaggaatgaaggcctgcagtgaggatggagtggtcggcctgaagccatctctagcaagtggtcaggacgctgattgttctgcgcaggttggaggtaggtggtgagtctgagaaaggggccggaaagactccccagcaactgctggcaaagggtgaagggcacgttcccacaggattcaagccagctgcctttggaggggagacgggcactcagtttaggcgctcctacagcagggtcagcaagacaagcaggttgcggcaagggtctgcgcactgctgtgtaaatgtaggggcatcggggggcagaaagaccaggggagaagtgtgcatcacccttggggttaagggacagttgtctgctaggtgttgcttcctggagatggctgaaaagccagtccagtctgcagggaccaggccaccacccacctgatgtgggagcatttcccccaatccctgctgggctgctgaatctgggggacatagggaagctgaggctggtgttctgagtagtggcagagctgagccacagggcatgtctgaggtcagccccgagcaaaatggaatagggactcagggtgggtcaggtaactggaaagcgggcactgtgcacgcagcccttgaggggagccagggtgggtggggatcccccactgtgtgcagaaggcagcagccttggaagcagggtgtgctcctcggtgtggtcgctcgataccagaaaatgactctaaaaactgaagagtgtttgagtttcattcacacaaaacatggacatcatctgtgaggctctgtcccagagagacagggccatccctcatgtctgttattgggttgtagataaacaaaagtat

SEQ ID NO: 359624 - DNA, 2198 bp, Homo sapiens
tccgcggtgccggccgacccggaagcatgtctgtccctagcggaggcgcgggtgccgtgctgagagcgcctgcctgtgcgccccgagcggggctgggactcttccaagatgcccacgttcgcacagagaccccggatcgcggaagctcgcgtctcgaaaggcctgtgggtcaaggggggccatctcggtgggatctggggcgggacgacccccactgctgaaccctgggcgcggggcagggtcagaggctccgctcggcctccccctggatgagacgcgcatgcccggtgtcccccggccgccgtcggcgtcgtgtcttcagtccttatcgactccagactttggggatgcgtattaacgccagactcctgcaaagtcttgccttcaacactcagctcctggggagagacgggtggagggatgactggaaacgtggcctcgacgtccctacagagcccctccagcgtggggaggcctaagtacctcaaggttcaggcccacggaaggagtcgggggagcgaggcccggtgatctacgtgtgaaggagcttggacaggacctcacaaacgccagggagacggcgagggggttcgtgcgtttgtaacgtcttgacatcgctgatcctcccgcaggcggtctcacgccctgcccgtcctgggttcacggtttttcatcacctgcggctgtcctgcgatcgaccacagctgtgcaggaggggcaggaggtatctgttgctgcagttaccggaacctttgccaggactagtacaggaccacgggctggtagctcagggatgtctcgtctgtgagttacagctgcacgctctccaggaaagaaggaatttcctcttctctggaaaccccaccacacagctggtttctcattggtgctgcttgcccattccctgagctgtgactgccagaggagtgggaggttggtggtgcctccagcccatcaggggcaggccctgggaccgcctgggaacaggaggactatggcacaaaccgagtgagtgatgggagcaacccgcagggctctgccacatccctgtcttccttcactgacatgaaacgcagaaaaggcagctttgccacaacacaggagcacgcaccgaatgtggccgcccagggctctgtccttgaccctgttgtccaggactgtttaccaagggctgacaggcactgagtgccccgtgcacctggccagacactgcactcatgcagcggaaaggacagtgaacgagactttgtccctggcctccaaaggcttagggcgtagtggctgtcatgaggcacagtgacaagggccaggagggggacctcttagggggccatgcagtgatggaagccagaaggaatgaaggcctgcagtgaggatggagtggtcggcctgaagccatctctagcaagtggtcaggacgctgattgttctgcgcaggttggaggtaggtggtgagtctgagaaaggggccggaaagactccccagcaactgctggcaaagggtgaagggcacgttcccacaggattcaagccagctgcctttggaggggagacgggcactcagtttaggcgctcctacagcagggtcagcaagacaagcaggttgcggcaagggtctgcgcactgctgtgtaaatgtaggggcatcggggggcagaaagaccaggggagaagtgtgcatcacccttggggttaagggacagttgtctgctaggtgttgcttcctggagatggctgaaaagccagtccagtctgcagggaccaggccaccacccacctgatgtgggagcatttcccccaatccctgctgggctgctgaatctgggggacatagggaagctgaggctggtgttctgagtagtggcagagctgagccacagggcatgtctgaggtcagccccgagcaaaatggaatagggactcagggtgggtcaggtaactggaaagcgggcactgtgcacgcagcccttgaggggagccagggtgggtggggatcccccactgtgtgcagaaggcagcagccttggaagcagggtgtgctcctcggtgtggtcgctcgataccagaaaatgactctaaaaactgaagagtgtttgagtttcattcacacaaaacatggacatcatctgtgaggctctgtcccagagagacagggccatccctcatgtctgttattgggttgtagataaacaaaagtat

SEQ ID NO: 359625 - DNA, 1729 bp, Homo sapiens
tccgcggtgccggccgacccggaagcatgtctgtccctagcggaggcgcgggtgccgtgctgagagcgcctgcctgtgcgccccgagcggggctgggactcttccaagatgcccacgttcgcacagagaccccggatcgcggaagctcgcgtctcgaaaggcctgtgggtcaaggggggccatctcggtgggatctggggcgggacgacccccactgctgaaccctgggcgcggggcagggtcagaggctccgctcggcctccccctggatgagacgcgcatgcccggtgtcccccggccgccgtcggcgtcgtgtcttcagtccttatcgactccagactttggggatgcgtattaacgccagactcctgcaaagtcttgccttcaacactcagctcctggggagagacgggtggagggatgactggaaacgtggcctcgacgtccctacagagcccctccagcgtggggaggcctaagtacctcaaggttcaggcccacggaaggagtcgggggagcgaggcccggtgatctacgtgtgaaggagcttggacaggacctcacaaacgccagggagacggcgagggggttcgtgcgtttgtaacgtcttgacatcgctgatcctcccgcaggcggtctcacgccctgcccgtcctgggttcacggtttttcatcacctgcggctgtcctgcgatcgaccacagctgtgcaggaggggcaggaggtatctgttgctgcagttaccggaacctttgccaggactagtacaggaccacgggtgaggatggtggggaagcctgcgtggggcagggaacggtgaggcaggaagagggaagggcagcagaggcctgagtggttgcaggttcacacactgagctgccagtaactgcccagctcagacgggctcaaattcagaagccaccattgctcctcacccccacccccaggacgctgattgttctgcgcaggttggaggtaggtggtgagtctgagaaaggggccggaaagactccccagcaactgctggcaaagggtgaagggcacgttcccacaggattcaagccagctgcctttggaggggagacgggcactcagtttaggcgctcctacagcagggtcagcaagacaagcaggttgcggcaagggtctgcgcactgctgtgtaaatgtaggggcatcggggggcagaaagaccaggggagaagtgtgcatcacccttggggttaagggacagttgtctgctaggtgttgcttcctggagatggctgaaaagccagtccagtctgcagggaccaggccaccacccacctgatgtgggagcatttcccccaatccctgctgggctgctgaatctgggggacatagggaagctgaggctggtgttctgagtagtggcagagctgagccacagggcatgtctgaggtcagccccgagcaaaatggaatagggactcagggtgggtcaggtaactggaaagcgggcactgtgcacgcagcccttgaggggagccagggtgggtggggatcccccactgtgtgcagaaggcagcagccttggaagcagggtgtgctcctcggtgtggtcgctcgataccagaaaatgactctaaaaactgaagagtgtttgagtttcattcacacaaaacatggacatcatctgtgaggctctgtcccagagagacagggccatccctcatgtctgttattgggttgtagataaacaaaagtat

SEQ ID NO: 359626 - DNA, 2499 bp, Homo sapiens
tccgcggtgccggccgacccggaagcatgtctgtccctagcggaggcgcgggtgccgtgctgagagcgcctgcctgtgcgccccgagcggggctgggactcttccaagatgcccacgttcgcacagagaccccggatcgcggaagctcgcgtctcgaaaggcctgtgggtcaaggggggccatctcggtgggatctggggcgggacgacccccactgctgaaccctgggcgcggggcagggtcagaggctccgctcggcctccccctggatgagacgcgcatgcccggtgtcccccggccgccgtcggcgtcgtgtcttcagtccttatcgactccagactttggggatgcgtattaacgccagactcctgcaaagtcttgccttcaacactcagctcctggggagagacgggtggagggatgactggaaacgtggcctcgacgtccctacagagcccctccagcgtggggaggcctaagtacctcaaggttcaggcccacggaaggagtcgggggagcgaggcccggtgatctacgtgtgaaggagcttggacaggacctcacaaacgccagggagacggcgagggggttcgtgcgtttgtaacgtcttgacatcgctgatcctcccgcaggcggtctcacgccctgcccgtcctgggttcacggtttttcatcacctgcggctgtcctgcgatcgaccacagctgtgcaggaggggcaggaggtatctgttgctgcagttaccggaacctttgccaggactagtacaggaccacgggtgaggatggtggggaagcctgcgtggggcagggaacggtgaggcaggaagagggaagggcagcagaggcctgagtggttgcaggttcacacactgagctgccagtaactgcccagctcagacgggctcaaattcagaagccaccattgctcctcacccccacccccaggtcagctgtccactagctctgccatgacttgatactgcagctcaaacagtgccaaccaaaacccactctcctcaccgcctgttatgggtaacacggtatggttacagctttactcatgtcctctttccccaggctggtagctcagggatgtctcgtctgtgagttacagctgcacgctctccaggaaagaaggaatttcctcttctctggaaaccccaccacacagctggtttctcattggtgctgcttgcccattccctgagctgtgactgccagaggagtgggaggttggtggtgcctccagcccatcaggggcaggccctgggaccgcctgggaacaggaggactatggcacaaaccgagtgagtgatgggagcaacccgcagggctctgccacatccctgtcttccttcactgacatgaaacgcagaaaaggcagctttgccacaacacaggagcacgcaccgaatgtggccgcccagggctctgtccttgaccctgttgtccaggactgtttaccaagggctgacaggcactgagtgccccgtgcacctggccagacactgcactcatgcagcggaaaggacagtgaacgagactttgtccctggcctccaaaggcttagggcgtagtggctgtcatgaggcacagtgacaagggccaggagggggacctcttagggggccatgcagtgatggaagccagaaggaatgaaggcctgcagtgaggatggagtggtcggcctgaagccatctctagcaagtggtcaggacgctgattgttctgcgcaggttggaggtaggtggtgagtctgagaaaggggccggaaagactccccagcaactgctggcaaagggtgaagggcacgttcccacaggattcaagccagctgcctttggaggggagacgggcactcagtttaggcgctcctacagcagggtcagcaagacaagcaggttgcggcaagggtctgcgcactgctgtgtaaatgtaggggcatcggggggcagaaagaccaggggagaagtgtgcatcacccttggggttaagggacagttgtctgctaggtgttgcttcctggagatggctgaaaagccagtccagtctgcagggaccaggccaccacccacctgatgtgggagcatttcccccaatccctgctgggctgctgaatctgggggacatagggaagctgaggctggtgttctgagtagtggcagagctgagccacagggcatgtctgaggtcagccccgagcaaaatggaatagggactcagggtgggtcaggtaactggaaagcgggcactgtgcacgcagcccttgaggggagccagggtgggtggggatcccccactgtgtgcagaaggcagcagccttggaagcagggtgtgctcctcggtgtggtcgctcgataccagaaaatgactctaaaaactgaagagtgtttgagtttcattcacacaaaacatggacatcatctgtgaggctctgtcccagagagacagggccatccctcatgtctgttattgggttgtagataaacaaaagtat

SEQ ID NO: 359627 - DNA, 1905 bp, Homo sapiens
tccgcggtgccggccgacccggaagcatgtctgtccctagcggaggcgcgggtgccgtgctgagagcgcctgcctgtgcgccccgagcggggctgggactcttccaagatgcccacgttcgcacagagaccccggatcgcggaagctcgcgtctcgaaagagcccctccagcgtggggaggcctaagtacctcaaggttcaggcccacggaaggagtcgggggagcgaggcccggtgatctacgtgtgaaggagcttggacaggacctcacaaacgccagggagacggcgagggggttcgtgcgtttgtaacgtcttgacatcgctgatcctcccgcaggcggtctcacgccctgcccgtcctgggttcacggtttttcatcacctgcggctgtcctgcgatcgaccacagctgtgcaggaggggcaggaggtatctgttgctgcagttaccggaacctttgccaggactagtacaggaccacgggctggtagctcagggatgtctcgtctgtgagttacagctgcacgctctccaggaaagaaggaatttcctcttctctggaaaccccaccacacagctggtttctcattggtgctgcttgcccattccctgagctgtgactgccagaggagtgggaggttggtggtgcctccagcccatcaggggcaggccctgggaccgcctgggaacaggaggactatggcacaaaccgagtgagtgatgggagcaacccgcagggctctgccacatccctgtcttccttcactgacatgaaacgcagaaaaggcagctttgccacaacacaggagcacgcaccgaatgtggccgcccagggctctgtccttgaccctgttgtccaggactgtttaccaagggctgacaggcactgagtgccccgtgcacctggccagacactgcactcatgcagcggaaaggacagtgaacgagactttgtccctggcctccaaaggcttagggcgtagtggctgtcatgaggcacagtgacaagggccaggagggggacctcttagggggccatgcagtgatggaagccagaaggaatgaaggcctgcagtgaggatggagtggtcggcctgaagccatctctagcaagtggtcaggacgctgattgttctgcgcaggttggaggtaggtggtgagtctgagaaaggggccggaaagactccccagcaactgctggcaaagggtgaagggcacgttcccacaggattcaagccagctgcctttggaggggagacgggcactcagtttaggcgctcctacagcagggtcagcaagacaagcaggttgcggcaagggtctgcgcactgctgtgtaaatgtaggggcatcggggggcagaaagaccaggggagaagtgtgcatcacccttggggttaagggacagttgtctgctaggtgttgcttcctggagatggctgaaaagccagtccagtctgcagggaccaggccaccacccacctgatgtgggagcatttcccccaatccctgctgggctgctgaatctgggggacatagggaagctgaggctggtgttctgagtagtggcagagctgagccacagggcatgtctgaggtcagccccgagcaaaatggaatagggactcagggtgggtcaggtaactggaaagcgggcactgtgcacgcagcccttgaggggagccagggtgggtggggatcccccactgtgtgcagaaggcagcagccttggaagcagggtgtgctcctcggtgtggtcgctcgataccagaaaatgactctaaaaactgaagagtgtttgagtttcattcacacaaaacatggacatcatctgtgaggctctgtcccagagagacagggccatccctcatgtctgttattgggttgtagataaacaaaagtat

SEQ ID NO: 359628 - DNA, 524 bp, Homo sapiens
tccgcggtgccggccgacccggaagcatgtctgtccctagcggaggcgcgggtgccgtgctgagagcgcctgcctgtgcgccccgagcggggctgggactcttccaagatgcccacgttcgcacagagaccccggatcgcggaagctcgcgtctcgaaaggcggtctcacgccctgcccgtcctgggttcacggtttttcatcacctgcggctgtcctgcgatcgaccacagctgtgcaggaggggcaggaggtatctgttgctgcagttaccggaacctttgccaggactagtacaggaccacgggctggtagctcagggatgtctcgtctgtgagttacagctgcacgctctccaggaaagaaggaatttcctcttctctggaaaccccaccacacagctggtttctcattggtgctgcttgcccattccctgagctgtgactgccagaggagtgggaggttggcggcatgtccagcctgttaggtgtgacacttgtgatggcttggaaacaggcggaccat

SEQ ID NO: 359629 - DNA, 1672 bp, Homo sapiens
tccgcggtgccggccgacccggaagcatgtctgtccctagcggaggcgcgggtgccgtgctgagagcgcctgcctgtgcgccccgagcggggctgggactcttccaagatgcccacgttcgcacagagaccccggatcgcggaagctcgcgtctcgaaaggcggtctcacgccctgcccgtcctgggttcacggtttttcatcacctgcggctgtcctgcgatcgaccacagctgtgcaggaggggcaggaggctggtagctcagggatgtctcgtctgtgagttacagctgcacgctctccaggaaagaaggaatttcctcttctctggaaaccccaccacacagctggtttctcattggtgctgcttgcccattccctgagctgtgactgccagaggagtgggaggttggtggtgcctccagcccatcaggggcaggccctgggaccgcctgggaacaggaggactatggcacaaaccgagtgagtgatgggagcaacccgcagggctctgccacatccctgtcttccttcactgacatgaaacgcagaaaaggcagctttgccacaacacaggagcacgcaccgaatgtggccgcccagggctctgtccttgaccctgttgtccaggactgtttaccaagggctgacaggcactgagtgccccgtgcacctggccagacactgcactcatgcagcggaaaggacagtgaacgagactttgtccctggcctccaaaggcttagggcgtagtggctgtcatgaggcacagtgacaagggccaggagggggacctcttagggggccatgcagtgatggaagccagaaggaatgaaggcctgcagtgaggatggagtggtcggcctgaagccatctctagcaagtggtcaggacgctgattgttctgcgcaggttggaggtaggtggtgagtctgagaaaggggccggaaagactccccagcaactgctggcaaagggtgaagggcacgttcccacaggattcaagccagctgcctttggaggggagacgggcactcagtttaggcgctcctacagcagggtcagcaagacaagcaggttgcggcaagggtctgcgcactgctgtgtaaatgtaggggcatcggggggcagaaagaccaggggagaagtgtgcatcacccttggggttaagggacagttgtctgctaggtgttgcttcctggagatggctgaaaagccagtccagtctgcagggaccaggccaccacccacctgatgtgggagcatttcccccaatccctgctgggctgctgaatctgggggacatagggaagctgaggctggtgttctgagtagtggcagagctgagccacagggcatgtctgaggtcagccccgagcaaaatggaatagggactcagggtgggtcaggtaactggaaagcgggcactgtgcacgcagcccttgaggggagccagggtgggtggggatcccccactgtgtgcagaaggcagcagccttggaagcagggtgtgctcctcggtgtggtcgctcgataccagaaaatgactctaaaaactgaagagtgtttgagtttcattcacacaaaacatggacatcatctgtgaggctctgtcccagagagacagggccatccctcatgtctgttattgggttgtagataaacaaaagtat

SEQ ID NO: 359630 - DNA, 1071 bp, Homo sapiens
ggtcatccaagccaatgaacttagattctcatgtggaatgatttatgtattttaaacaaagccttcatcttatttagaaatcacttgcatgaggcactcttttgaaaatgttctcctcatctggaaaataatttggctgtataatcgtggtattcaggaagttagggcaggtgtttaggtggaagagcagaagggagtattccaatgaggctgaagagtgaggggaattgaccccctgggagaagggaaggcatgtcagggccctccttttaacaggaaaggattgaagaaggcagtgaccctgagagaagaggagaagccaggcctgggcgccaaacacttttgggcctgttgctttgaagggtagaaagagtggccataatatttctcctgacccagcagatttgaaaagattcctccagcagacagtggaaagccccttgcttcctcagccattcagtctgatttctgaaataactatgctatttcctggttgtggtgaagtggcagggcccgagggtttgatcagcttttcatgggctatggccattagtggggttggggtgcaggtgggagtttgttaacacaagagcttgttattctcggagcttcaggccctggtttggaaatgttaactggccaaccagccacgggagttggaattccctaactattgtcagagagagtgcaaagggatttgtctgattgaacaatctgcatttgaagatgacctggacctgcctgcatcccgcatggcagaggtggacatttggaaggtgcgtttgctcatgtttcctcttctctccccagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgttt

SEQ ID NO: 359631 - DNA, 1668 bp, Homo sapiens
ggtcatccaagccaatgaacttagattctcatgtggaatgatttatgtattttaaacaaagccttcatcttatttagaaatcacttgcatgaggcactcttttgaaaatgttctcctcatctggaaaataatttggctgtataatcgtggtattcaggaagttagggcaggtgtttaggtggaagagcagaagggagtattccaatgaggctgaagagtgaggggaattgaccccctgggagaagggaaggcatgtcagggccctccttttaacaggaaaggattgaagaaggcagtgaccctgagagaagaggagaagccaggcctgggcgccaaacacttttgggcctgttgctttgaagggtagaaagagtggccataatatttctcctgacccagcagatttgaaaagattcctccagcagacagtggaaagccccttgcttcctcagccattcagtctgatttctgaaataactatgctatttcctggttgtggtgaagtggcagggcccgagggtttgatcagcttttcatgggctatggccattagtggggttggggtgcaggtgggagtttgttaacacaagagcttgttattctcggagcttcaggccctggtttggaaatgttaactggccaaccagccacgggagttggaattccctaactattgtcagagagagtgcaaagggatttgtctgattgaacaatctgcatttgaagatgacctggacctgcctgcatcccgcatggcagaggtggacatttggaaggtgcgtttgctcatgtttcctcttctctccccagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctctccaaggcacaaaccttactatggaaagcagccatatttgcagataccactgtctccttttgtcctcttcgtggctggaattcaaaagcatgtatttctgaagcctcttgtgacattgtttttttttttttttaattaaacagaaaagatatttgacatgca

SEQ ID NO: 359632 - DNA, 1787 bp, Homo sapiens
cactctgggcggcggatccgagcgggggataccccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgttt

SEQ ID NO: 359633 - DNA, 2029 bp, Homo sapiens
cactctgggcggcggatccgagcgggggataccccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctctccaaggcacaaaccttactatggaaagcagccatatttgcagataccactgtctccttttgtcctcttcgtggctggaattcaaaagcatgtatttctgaagcctcttgtgacattgtttttttttttttttaattaaacagaaaagatatttgacatgca

SEQ ID NO: 359634 - DNA, 1538 bp, Homo sapiens
  misc_feature (1537)..(1537): n is a, c, g, or t
cactctgggcggcggatccgagcgggggataccccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaaggtatggaagctagaggggccactagaaaatcttgagaaaagtaaagttttgtttatatcacaagcaaagtccattgcagaaagcatcattattccaggactcagaatgctgaagagagaactgtgcccccagcagagtctttttctttctttctttctttttttttactgcatcaggattcaatacaatgagaatctactgcaatccaaaagcgcgaattgaaccttgaaccttgagatacatgttcctgggagatgaattgtggtgaacttgagtctaatgattggtcctgctcctttaaaatacttgtttgacattgctaaaggggagattgtacaagtcccataaactcagttacttttaattattatattcaaatatcctcacttgagaaggtgtcctcctttcctctcttacttctgaaatgtatcattttattctgagagtattatccaacataaaattgaatttttctgtaagactacagcaatattttctaattgaaaaagcagtattaaactcaatgatttttcatcnc

SEQ ID NO: 359635 - DNA, 728 bp, Homo sapiens
ctgttcgactcttggaaaactgccacagtggaatcaccactgttgtcctggtttacagtttgacatcttttttatgtgtcgaatattttggtgagttctgagtggctcatgcttcacgtacaagggttttcccatgaaatttacattgagttgtccacctccagcttatagggcttctggaacagagtgggtcttgctcttagtgattccatgggagaaaatggaattggaggtactagtagaattcagggaactgtccagtcagagacttcgactgtcatggatttggagctttccttgccactggatgagggcatgatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggactggatgagggcagggacctctagatcgaccacagcatgcagctgcacccca

SEQ ID NO: 359636 - DNA, 319 bp, Homo sapiens
cactctgggcggcggatccgagcgggggataccccaggagatgggggtcgaggagagaccccggggagtagagagagagaaactcactccccgagtccccgaccctccccaagcaaggtgaggtcaacgccacccaccttcccccggtcaccctgggaggggtcgctccggcgggcgtctgctggagggtagaagcggggaagggaggcagcggcggcgcccaggcggcggtaggtagccgggcggcgagggcgcccgcaccccccggccgctgcgctgcgctgcggtgcgcacgggctccgccggttgctattccggc

SEQ ID NO: 359637 - DNA, 1743 bp, Homo sapiens
ggcgggggcgcgccgggcgggctgcaggaagcagcaggagacgcccggcagccgggacggtcggggacgcctggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgttt

SEQ ID NO: 359638 - DNA, 2152 bp, Homo sapiens
ctgtcatcccggcacttggggaaaccggggtgggtggatcacctgaggtcaagggtttgagaccagcctggccgtctttactttaaataccctaaaaaaaaaaaaaaaatcagctgggcgtggtagcacacacctgtaatcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctctccaaggcacaaaccttactatggaaagcagccatatttgcagataccactgtctccttttgtcctcttcgtggctggaattcaaaagcatgtatttctgaagcctcttgtgacattgtttttttttttttttaattaaacagaaaagatatttgacatgca

SEQ ID NO: 359639 - DNA, 2157 bp, Homo sapiens
agcagatgccttggcctttggagagtgatctaaaatggcctagtcggagagatgctaatcacatacgctccattcctcctcaaagggccaaatgtagaaatgggcagtggtcatgccttggccatcctccatgaacacgggattggccccagcttcaaatgagcactcagcccaggctcaagaccacccccaacaacgcggatggaggtgcttgccagtggtccagttagtagcagtaaactaagggatgggtacatggataatcttctctggctgactaatcagttggaactacatgcatttcgattattattcagcaaatattgatggagcatcttctacattccaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctctccaaggcacaaaccttactatggaaagcagccatatttgcagataccactgtctccttttgtcctcttcgtggctggaattcaaaagcatgtatttctgaagcctcttgtgacattgtttttttttttttttaattaaacagaaaagatatttgacatgca

SEQ ID NO: 359640 - DNA, 2022 bp, Homo sapiens
tgcactccagcctgagcgacagagcaagactccatctcaaaaaaaaaaaaaaagaaaattaagactaggttccttgtcttcaaagagctcaaagtttaggaagaatctggagatagtgaagtctatttttctatacctctaggacagagcagagtgtgctaagtgaaataagttctaagaaagccagtgacagcttaaagagggagaaatagaatcagctgagggattgcaacagtagagcgttaattatttaccctgggttttggaggatggatcagatgagaaaaagagaatggagaggagaatgtcccaggtggtgggagcagcatgagttctgggaggcagcatttggggaaacagggaggcatttagtttggctgaaatacagagtgtaattgggggcataatgggaagcatggaaatgagttagaatcatgctttaaagaatcttcaaagctacagagagtcatacttccctggggaccaggactagaactgggcattcaaaacattaatagctttactgtctttctttgcagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctctccaaggcacaaaccttactatggaaagcagccatatttgcagataccactgtctccttttgtcctcttcgtggctggaattcaaaagcatgtatttctgaagcctcttgtgacattgtttttttttttttttaattaaacagaaaagatatttgacatgca

SEQ ID NO: 359641 - DNA, 2502 bp, Homo sapiens
  misc_feature (2502)..(2502): n is a, c, g, or t
tggcggccgccgcaggaagggccggttcctgcgctccccccgcccctttccctcgccttcggctgacgctgacgtcggatgagtgatccggagggacgctccgaccgcggccgggaggctcctgggggccggggctccgaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttaaacacaaaaaaacaaaagaaaaaaaaaaaaaacaaaacacaaaaacaacaaaaagaaacaagggggggcgcgcgccgcccaaaagatttgccccgcggggggcgccgccatagaaataaacgcgcgcgggccccccgccgttttacttgcgagcgaacaagagggcgcgccgccactaaagaagagagagcgcgggatatataatacaacccgaggagcgagcgcggagcacgagcgcgccgcggtctatactaacaagcgcccggacgagagggggagacacacacgcgggagccgaaatcgcgcgcgggagacagtcttgtgtgaagacaggagagagacacgcgcttcaatgggcgagggggggggcagggacacaaatatgggggggcaggcacaacacacctcacacccgagagagagaatttataaacagcgcctccagaggggggacgatcacatatactcagaaccttttttcaacagcagcgagcgcgagatctaacggtgcgctgtgtgaaacaaccacacacgcgtgcgcggatacttacgcgcttgcgacgcgcccgctggtaaagaaaaaaattctggcgccgtcggccccaccgcgggagcaatctcgctactaacctctagaagagacccattttttactcccccagagggcggggaggggactactataacagn

SEQ ID NO: 359642 - DNA, 1136 bp, Homo sapiens
tggcggccgccgcaggaagggccggttcctgcgctccccccgcccctttccctcgccttcggctgacgctgacgtcggatgagtgatccggagggacgctccgaccgcggccgggaggctcctgggggccggggctccgaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccaggtaacaaaataatgtttgttgcaatgaaccaaggatggcacaaggtttaaataacatcaaaatggtgtttgagctaaaagtaagctttggccattgtgaagttctgaatgcctttccgtaatttcacttcccacatctctgccttctaggacaagagttatcgacgtagcgcttggtagctatttcctgattataatatgtctttctagag

SEQ ID NO: 359643 - DNA, 1157 bp, Homo sapiens
tggcggccgccgcaggaagggccggttcctgcgctccccccgcccctttccctcgccttcggctgacgctgacgtcggatgagtgatccggagggacgctccgaccgcggccgggaggctcctgggggccggggctccgagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaagttacaaaacacaagtgcgccttgcaaaaaaaactttgacaaactttgaacgacattgggatttgggtctgtcccaacacggggatcctctgtggaggacggagcgaagaatgcaatctcttgtctccaatgtaggaacttccagacactctggttccatttgggagcaactctccacctatggggggctcccctgagaggttcaaaggtttaaccccatggattcactttaagaagctcaaaccctaacaattttctggcaaacgaagcaacaacatctcaggaggttaatgggaggagaccgcccaatattgagaaagacccgggcccttatacagagagagaatgcgagaggcagcagggcgcgccagaaaacacatagagggggagcgcccagcaacatagctgtcaatcagacaaagcg

SEQ ID NO: 359644 - DNA, 418 bp, Homo sapiens
agtttccatttgtaggtcattttaataatataatgtatatatttttgagactagactatgggaagtctttctgttgctgactgctgccaaaccccttttcagtaatcacaaattaataattggtcatttttctacatcagtaatattttattaagacaatcattttggtaggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaag

SEQ ID NO: 359645 - DNA, 2275 bp, Homo sapiens
ggcgggggcgcgccgggcgggctgcaggaagcagcaggagacgcccggcagccgggacggtcggggacgcctgaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctctccaaggcacaaaccttactatggaaagcagccatatttgcagataccactgtctccttttgtcctcttcgtggctggaattcaaaagcatgtatttctgaagcctcttgtgacattgtttttttttttttttaattaaacagaaaagatatttgacatgca

SEQ ID NO: 359646 - DNA, 2025 bp, Homo sapiens
tggcggccgccgcaggaagggccggttcctgcgctccccccgcccctttccctcgccttcggctgacgctgacgtcggatgagtgatccggagggacgctccgaccgcggccgggaggctcctgggggccggggctccgaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgttcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgttt

SEQ ID NO: 359647 - DNA, 1811 bp, Homo sapiens
tggcggccgccgcaggaagggccggttcctgcgctccccccgcccctttccctcgccttcggctgacgctgacgtcggatgagtgatccggagggacgctccgaccgcggccgggaggctcctgggggccggggctccgaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgttt

SEQ ID NO: 359648 - DNA, 2343 bp, Homo sapiens
tggcggccgccgcaggaagggccggttcctgcgctccccccgcccctttccctcgccttcggctgacgctgacgtcggatgagtgatccggagggacgctccgaccgcggccgggaggctcctgggggccggggctccgagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctctccaaggcacaaaccttactatggaaagcagccatatttgcagataccactgtctccttttgtcctcttcgtggctggaattcaaaagcatgtatttctgaagcctcttgtgacattgtttttttttttttttaattaaacagaaaagatatttgacatgca

SEQ ID NO: 359649 - DNA, 2089 bp, Homo sapiens
tggtcgtgtcgcttaggatcctacatgtcatgggacgcgatgaacatgtgttgcttctgcgcgtcacctgggatgccaatctaactgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctctccaaggcacaaaccttactatggaaagcagccatatttgcagataccactgtctccttttgtcctcttcgtggctggaattcaaaagcatgtatttctgaagcctcttgtgacattgtttttttttttttttaattaaacagaaaagatatttgacatgca

SEQ ID NO: 359650 - DNA, 2380 bp, Homo sapiens
tggcggccgccgcaggaagggccggttcctgcgctccccccgcccctttccctcgccttcggctgacgctgacgtcggatgagtgatccggagggacgctccgaccgcggccgggaggctcctgggggccggggctccgaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccaaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctctccaaggcacaaaccttactatggaaagcagccatatttgcagataccactgtctccttttgtcctcttcgtggctggaattcaaaagcatgtatttctgaagcctcttgtgacattgtttttttttttttttaattaaacagaaaagatatttgacatgca

SEQ ID NO: 359651 - DNA, 1286 bp, Homo sapiens
tggcggccgccgcaggaagggccggttcctgcgctccccccgcccctttccctcgccttcggctgacgctgacgtcggatgagtgatccggagggacgctccgaccgcggccgggaggctcctgggggccggggctccgaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcaacctccagaatgcgagaaaatttttgcaatctatccatctgacaaagggctaatatctagaatctgcaaagtacttaaacttatttataagaacaaaacagccccatcaaaaagtgggaaaaagatttgaacagacacttctcaatagaagatattgatgcaaccataagcatgaaaaaagctc

SEQ ID NO: 359652 - DNA, 1139 bp, Homo sapiens
tggcggccgccgcaggaagggccggttcctgcgctccccccgcccctttccctcgccttcggctgacgctgacgtcggatgagtgatccggagggacgctccgaccgcggccgggaggctcctgggggccggggctccgaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccaggtaacaaaataatgtttgttgcaatgaaccaaggatggcacaaggtttaaataacatcaaaatggtgtttgagctaaaagtaagctttggccattgtgaagttctgaatgcctttccgtaatttcacttcccacatctctgccttctagggccctacgtttaaccaaaccaaatagtagttatttcctgtatataccataatttcccacttctg

SEQ ID NO: 359653 - DNA, 3230 bp, Homo sapiens
  misc_feature (638)..(638): n is a, c, g, or t
actccttttattttattttcctatgtttagttttctttggagttgaacagctaggctgaatgagattaaagttttccaaacacacatggcagtatggaggttttatgaaaagtgatggtgaagagttgggagagatggagggaaaaaaatgcagtcagaagtttcagaacaaatacacaaaatcctatgttagtttgaatctttatttttctggcacacttttaaaaggctgtattaaaatagtgatttttttttttttgcctcagggaacctcagtcaacaggaatacctctgtttctaacctagagaataatattgttaaaattgctttgttaatttttttttcctcaggaataattttctcttttggaaagcactttccccgtctcagtagaaaagtctagcagttgtaacttcttgtttcttatttgctttgggggaaatcaaagaaaacagacggtgaaggaaagggtgggaaaaattaagtctcatgaaaaaaaaaaaagaggtccggggagagacctgggccaaatggtcacagcaccaactggcgtggcccaggaaattgaaacaatcctgctccatgtggggccccacagggccactggctgcccgatcccaggtttggctgagcaaanacaagggctggaggtggtggtacctgcagcagggccatggacagatgagtctcggttcagctggctcttgaggttaaaaatcatcaggaagtttctaggtcaggctgttgttgtcttcctggtgggagagtggtgggaagtggagaggatacctcacaagagaagcttctctgctgaacttgcttctcctgcctgttcttttaggagatcctttggttttccttcaggctagactttgcttgggcaagagacctaaaccgacttggaaggaggcaaaggctggaagcatagaagcctctgggctcagaggagggtgttgatgatgcttttattttggagtctcctagtgtcccctcccttgagccatcctatcccagagttggggaggagagatagggagagagggactaggggaggtcaggggctagtgcacaggcaggagagaagcaatggcctttgccatagattctacatctaggcagtcttgaaaggcatatagtctttatttatttttttattttttagtggaaatgaaaactggtgggcttttttttctcagcatctgctttggagatgttggggaggggaaaagaaaaaaccctattgatgtcagttcccttttcagttcctaagatggattcgagccccagtcctcttctcccccttgtgtctcttctctcgcctcgcaggtcagccgcttggaacagaccccggaggaggggggcagagaggggaggtgggggggggggggtccggcgtgtcacgtgacccccagggttgccaatgtccggtcctgagggtatcaggcctttccaagttgccacccactgcccaggcctcacccagcgatgcagaaagccacctactacgacaacgccgcggctgctctcttcggaggctattcctcgtaccctggcagcaatggcttcggcttcgatgtccccccccaacccccatttcaggccgccacgcacctggagggcgactaccagcgctcagcttgctcgctgcagtccctgggcaacgctgccccacatgccaagagcaaggagctcaacggcagctgcatgaggccgggtctggcccccgagaccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaacctggaggtctgaaaagaggagccagagaaggtggtacccaggcttcctggtcagaaccggcctggagctccttcccttccccctggcctgagaggttgcttttaagtcttccaccccttgttccatctgcctgccaacccatcggaaaggaatccacatcatattggagatgaccccatcaaccccagggctccagcactaccaagttggaattccacgcccgggagtggggtagaggaagacgagacaggacgaggcagaaaagcacattttaaaaaccagacaagatggctaggccatcaccaaccaacggacttaccttacatctttgtaggtaattccccccaaatcttgattttttttttcctcaattatccttt

SEQ ID NO: 359654 - DNA, 634 bp, Homo sapiens
ccccaccccctcttgttctggatcccagatcttgggtccccttagcacctttctctcttcccactgtcccgtccgccaggcctcggcgccctccaacccggagccctgctgagcaaagtcccgaagcggagtttctaaggcgccttttaattcggttacctccagctcccaaaacttgctgccgcccgcggggctcggccctcggccggctggtgtgctgggaacctgcctccgataaccgttttggtgtcctgatcgcttgctcttcttcgcctccttgggccatcgtaggtggctggtagcttgtcgccagtcgccgcggcagcagcgaccggctgaggcagcctggcagcagcagccagggactacccgggtgcacaaaccttcccagccctgtctgcaccaccggcggagtctccattctttcctatcgcgtctctggctccttcgctttccacactcgcctggcctccgtcccgcgatggtttggggtttattgcaaggggagcggcaggaatttcggccccaggcatctagttaaattattgttttattattattactatcatcatcatcgtcatcattattattgctgtaacaatcagactaaataaagccagggcctagccagcca

SEQ ID NO: 359655 - DNA, 462 bp, Homo sapiens
aggattccatgaggctggcctctttcctcgcagcataagaagcaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgcctctccattctttcctatcgcgtctctggctccttcgctttccacactcgcctggcctccgtcccgcgatggtttggggtttattgcaaggggagcggcaggaatttcggccccaggcatctagttaaattattgttttattattattactatcatcatcatcgtcatcattattattgctgtaacaatcagactaaataaagccagggcctagccagcca

SEQ ID NO: 359656 - DNA, 187 bp, Homo sapiens
aggattccatgaggctggcctctttcctcgcagcataagaaggtatcgctttcctctgaggtgtttaaggctttaatgagtataattttttgcacagatgtttctgggtgtttgcaggttttcagagtatttttatattacaaagaagctagccagtgccatagctcaaactctgacaagcaaatag

SEQ ID NO: 359657 - DNA, 2642 bp, Homo sapiens
  misc_feature (387)..(387): n is a, c, g, or t
ttttgcattcctccagcttgcagctccggtagttggaggctgggtagggcagggggaaccgacaggccggtgtccccagccgcaaaagagctgctgaactgtccgtttaaatgctgctgggagactcgtaaaaaaatcatcgtggacctggaggatgagaggggcgagctttatttcggtcggattgcggtgtggtggtttagctgcaaggggatgccgcagccccagttgagggggaaaatagttcttaaaaagcatatgcccccctaaggaatgtctctaaagaaccaaatcaaagctgctctttggaaggtatgaatagaatttaaaaaaaaaagatttctatggagcttaaagttcacagccattctgtgtagacaagagctnagaaaaatgtgagaattatacagaaaaccattaatcacttcttttctttaaatacgtatcctctctcctttgttattattcaacagcaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgccgctcgctctggggctcgatgtgaatatatattatgtctgcctgttctcccctcgtcggtggctaaggtcagccgcttggaacagaccccggaggaggggggcagagaggggaggtgggggggggggggtccggcgtgtcacgtgacccccagggttgccaatgtccggtcctgagggtatcaggcctttccaagttgccacccactgcccaggcctcacccagcgatgcagaaagccacctactacgacaacgccgcggctgctctcttcggaggctattcctcgtaccctggcagcaatggcttcggcttcgatgtccccccccaacccccatttcaggccgccacgcacctggagggcgactaccagcgctcagcttgctcgctgcagtccctgggcaacgctgccccacatgccaagagcaaggagctcaacggcagctgcatgaggccgggtctggcccccgagaccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaacctggaggtctgaaaagaggagccagagaaggtggtacccaggcttcctggtcagaaccggcctggagctccttcccttccccctggcctgagaggttgcttttaagtcttccaccccttgttccatctgcctgccaacccatcggaaaggaatccacatcatattggagatgaccccatcaaccccagggctccagcactaccaagttggaattccacgcccgggagtggggtagaggaagacgagacaggacgaggcagaaaagcacattttaaaaaccagacaagatggctaggccatcaccaaccaacggacttaccttacatctttgtaggtaattccccccaaatcttgattttttttttcctcaattatccttt

SEQ ID NO: 359658 - DNA, 532 bp, Homo sapiens
tttaaaatttgtgggtatatactaatagtaggtgtatatatatatacatatatatatacatgtacatatatatatggggtacagccataaattattcaaaactaaatctggagatcagttcaccgtctcttctactttctaaggaaaagcaattcttactcatgaatggaaaaatgctctgcagtctctaagtgtgtgtggtggaggaggggaagttgacttgctcctagggagggatgtttaatcacatctaatgtgtcatgaaaattacacacatttttatacagaacaatacatattgactatttcttgtctttctctcctgctagaacatgaacttcatgaggacagagacttgggcttattcaccaccaagtccccagttcctaactccagtcctttggagttagaagcaggttgcccaaagttcatgatgcagaaaaaccattttttccgagatttataggataagtcctgtaattccagattgcttggcgccaatcaggtactcaataaatgtttgttgagtgaa

SEQ ID NO: 359659 - DNA, 1672 bp, Homo sapiens
ctgacaagacagaaagagagctgggttgaggtcggggcggattcagagcccaccgtgtcagcaaagacacataaggaactcgccctccggaaagacgcgggggaattctgggagtgcgcggccttggagcgcgacatgcgcggcagctcccgctgctgaatagctgagaggcgcacccgggcggccagctgggctcggagtgcagcggggttaggatggacgaggacgtgttgcaccctgaagagcctcatcatcgcctgctcttgaggttcacagatgatacctttgatccagaacttgcagcaacaatagatccatcttcggttgtgaatccggcccggaatgcagccaccccttagagcaaccccccttgctgctcgtgccctgctgtgctactgcctcagtcacttcctgcttggtcaagaccacagctgctgatgtcacagctgaggcacatcagaaaggctgcctgattcaaagaaagctgccggataaatcatagagcacagacacttctacctcatgctcttatgggactttaggaaccaaacataagcacctatggaaaatgcacggcggtcttgaaaggctgtggtctttatcagaaaatatctgaatgactgtttgttatgtcagtcctactctgcaggcttgctaagatgatgattgaaagggctcttggtttctgctttggaatctggcatttatgttttgaagcgttgtgagcaagcgatgtggcagattgcagggtgagggggacaaacctgggccaggagccaggggtttctctacccccttccctgacttacagctggaactgggctcagtggtttcagcctcatttgctaagaaggtctgggtatgtaatcctggctgcatcttaaaaatccctaggagcttttaagacatattgacacataagctctaactcacatgaaacgaaaacacatctctggggctgggctgagcaaatgcattttttaaaaggcccctcaggtgattctgtctcagagatgttgaaaaccagtgggttaggagctcagtcatccactttcagatctgtgattatgccactattaaatacagttggctatcacatagattttatgctttagcttgttcttttttcctttgctataccaaataaaatcttctgagctgtagttccagtccttaaaataatggttgttaccatactgaggttaaacattagtgcatttgcttaacaaggactttaaaacttatcacactgccataatttttaatggtttctataatgattaattaataagaaaatcaataattggattttaagcaggaaactaggcaggaaagttgaaattcatagaccaattcaatggaaaacattaaaatgtattgggagatgcccaatattctatgctgtttggtggttcactggtttctaatctattataacggcacccatagttaaaaagcactagtttttttttggtctgatagttgaaaaaacaacaatcctttgcacgtaggaattattttttccaacatcataatttctgactttgcacatattctattgaattgccaaaatgactttaaagagtctagtacatgcagggaatattacaattgcaatcattattttaacaccatctcctccccctcttcccttcccaaaagatataaagac

SEQ ID NO: 359660 - DNA, 1610 bp, Homo sapiens
ctgacaagacagaaagagagctgggttgaggtcggggcggattcagagcccaccgtgtcagcaaagacacataaggaactcgccctccggaaagacgcgggggaattctgggagtgcgcggccttggagcgcgacatgcgcggcagctcccgctgctgaatagctgagaggcgcacccgggcggccagctgggctcggagtgcagcggggttaggatggacgaggacgtgttgcaccctgaagagcctcatcatcgcctgctcttgaggttcacagatgatacctttgatccagaacttgcagcaacaatagatccatcttcggttgtgaatccggcccggaatgcagccaccccttagagcaaccccccttgctgctcgtgccctgctgtgctactgcctcagtcacttcctgcttggtcaagaccacagctgctgatgtcacagctgaggcacatcagaaaggctgcctgattcaaagaaagctgccggataaatcatagagcacagacacttctacctcatgctcttatgggactttaggaaccaaacataagcacctatggaaaatgcacggcggtcttgaaaggctgtggtctttatcagaaaatatctgaatgactgtttgttatgtcagtcctactctgcaggcttgctaagatgatgattgaaagggctcttggtttctgctttggaatctggcatttatgttttgaagcgttgtgagcaagcgatgtggcagattgcagggtgagggggacaaacctgggccaggagccaggggtttctctacccccttccctgacttacagctggaactgggctcagtggtttcagcctcatttgctaagaaggtctgggtatgtaatcctggctgcatctaacacatctctggggctgggctgagcaaatgcattttttaaaaggcccctcaggtgattctgtctcagagatgttgaaaaccagtgggttaggagctcagtcatccactttcagatctgtgattatgccactattaaatacagttggctatcacatagattttatgctttagcttgttcttttttcctttgctataccaaataaaatcttctgagctgtagttccagtccttaaaataatggttgttaccatactgaggttaaacattagtgcatttgcttaacaaggactttaaaacttatcacactgccataatttttaatggtttctataatgattaattaataagaaaatcaataattggattttaagcaggaaactaggcaggaaagttgaaattcatagaccaattcaatggaaaacattaaaatgtattgggagatgcccaatattctatgctgtttggtggttcactggtttctaatctattataacggcacccatagttaaaaagcactagtttttttttggtctgatagttgaaaaaacaacaatcctttgcacgtaggaattattttttccaacatcataatttctgactttgcacatattctattgaattgccaaaatgactttaaagagtctagtacatgcagggaatattacaattgcaatcattattttaacaccatctcctccccctcttcccttcccaaaagatataaagac

SEQ ID NO: 359661 - DNA, 489 bp, Homo sapiens
ttttattagtcgtctgtgaaagaacagctggatcttgtgaagtgctggaaattttctctttagtgtaagtggtccacggctgaagcagtcggaccacctttgaaaataacgtgtaattgttatttctcattttgccacatcctgtggagacaaaagattagtgttgtgtcttttcattttttatttttcttcttggggaaaataatattgacaatggagttgagtataagcctgctcttgaggttcacagatgatacctttgatccagaacttgcagcaacaatagaacatgaacttcatgaggacagagacttgggcttattcaccaccaagtccccagttcctaactccagtcctttggagttagaagcaggttgcccaaagttcatgatgcagaaaaaccattttttccgagatttataggataagtcctgtaattccagattgcttggcgccaatcaggtactcaataaatgtttgttgagtgaa

SEQ ID NO: 359662 - DNA, 439 bp, Homo sapiens
ctgacaagacagaaagagagctgggttgaggtcggggcggattcagagcccaccgtgtcagcaaagacacataaggaactcgccctccggaaagacgcgggggaattctgggagtgcgcggccttggagcgcgacatgcgcggcagctcccgctgctgaatagctgagaggcgcacccgggcggccagctgggctcggagtgcagcggggttaggatggacgaggacgtgttgcaccctgaagagcctcatcatcgcctgctcttgaggttcacagatgatacctttgatccagaacttgcagcaacaataggttcacctgcttccaggcgggcagggcgttgtattcatccctcgtcatgtctagtgcaaactggaaacattgggagaagcgccccgcggctcagtgaaaggagccgggcgtgcgtgtgttgttttac

SEQ ID NO: 359663 - DNA, 515 bp, Homo sapiens
ctgacaagacagaaagagagctgggttgaggtcggggcggattcagagcccaccgtgtcagcaaagacacataaggaactcgccctccggaaagacgcgggggaattctgggagtgcgcggccttggagcgcgacatgcgcggcagctcccgctgctgaatagctgagaggcgcacccgggcggccagctgggctcggagtgcagcggggttaggatggacgaggacgtgttgcaccctgaagagcctcatcatcgcctgctcttgaggttcacagatgatacctttgatccagaacttgcagcaacaatagaacatgaacttcatgaggacagagacttgggcttattcaccaccaagtccccagttcctaactccagtcctttggagttagaagcaggttgcccaaagttcatgatgcagaaaaaccattttttccgagatttataggataagtcctgtaattccagattgcttggcgccaatcaggtactcaataaatgtttgttgagtgaa

SEQ ID NO: 359664 - DNA, 376 bp, Homo sapiens
ctgacaagacagaaagagagctgggttgaggtcggggcggattcagagcccaccgtgtcagcaaagacacataaggaactcgccctccggaaagacgcgggggaattctgggagtgcgcggccttggagcgcgacatgcgcggcagctcccgctgctgaatagctgagaggcgcacccgggcggccagctgggctcggagtgcagcggggttaggatggacgaggacgtgttgcaccctgaagagcctcatcatcggtgagagtggggtgggcaagtccagcctgctcttgaggttcacagatgatacctttgatccagaacttgcagcaacaataggttaatgactgaagggctctggaaaggggataagaggcc

SEQ ID NO: 359665 - DNA, 2224 bp, Homo sapiens
ctgacaagacagaaagagagctgggttgaggtcggggcggattcagagcccaccgtgtcagcaaagacacataaggaactcgccctccggaaagacgcgggggaattctgggagtgcgcggccttggagcgcgacatgcgcggcagctcccgctgctgaatagctgagaggcgcacccgggcggccagctgggctcggagtgcagcggggttaggatggacgaggacgtgttgcaccctgaagagcctcatcatcggtgagagtggggtgggcaagtccagcctgctcttgaggttcacagatgatacctttgatccagaacttgcagcaacaatagacaatgcaggaatcacatgaacctgtccatccacagataaagtggtaaagaaactgccgtattagatacatgatggtatactcttcagccataaagcttcgggaaaccctgtcatccgcaaccacgtggagaaacctgtccatccacagatgaagggatcaggaagctctggtatatatactgaagggaaatgctttttggctaccaaaataatgaaattttgttgtttggagcaacacagatgaacctgtccatccacaaatgaagacatcaagaaactctagtatgtacacaaggcaaaacacttcagctatcaaaatcatgacattatgtcacttggagcaacacagttgacccgccaaggcagcctcttcctccatagatggatgaacgctgtggccgctgctcctgcctgggccatgccctgatgctgccaacaccactgctcctctatttataagtcttagtagagttgctgacccagcaataactgaacagctgatatgtacctcacactaagccaggcgcttcatatgtatctaacttgaaaaatgctgagctagttaccttaacaccattaacttttacttaaaagtttgtttttcttttttaatcccagtgagctccaaacaagttttaggaggctccccaaaaccagtgaagactttaactaaaagtagaatttcaaagtattagaaaccaaaccccaaaattaaatgtgaagatcagtgtctgtactgagctggcccatctggtggacacaggatttgcgttatcgactgcaatgttacccaggattcacgatttctagcatctgtcagggttaagaaaattggattgagtaccaaatacagcagagcaaacccggctttgaggcaagggccccatcaagtagtcatgcagtacttttgttagggttctgggtgcaaatcttcctcgtccctcccaccttctcctgggcctccttgtaaacccaaaccgccaggtaccttcaatttttctttcaagaccaggctgttcttaatgttggtaaattggtcaaggaaatgggtgagccactgcttgctctgcacatcgtcctcagagtgctcggtcttcaggcagtacagcagctgcatggctttggcctgcaggagtaagtggcccattcctaggctgtccccaaagatgtgtcctctgaagaagctggtcaggtagagggggtgtccactatggttatagatggggaaggagatgctgcccaggtcgagcgttttgtccacctgccaggtgtacaggagtgggttgggggcaccacgcagagcatcttgtacctcgcgcacacctgctggtactggagctggcttgcgtttccctgtgccacacgcagatcctgcactgtactgtccagtcaactgacttcagcaaagatgtctgggttcagcagcgagttgctgtgtgaggccaccagaatggaggtgatatcggcctcagtgctcatcctggaggtggagaagtggtcagagtcctctgtggtgaaatggccctacaccaaagtgggagacattcagaatcgaggcgaaattggcctcagtgctcctcttggaggcagagaagcagtaggagtcggtggtgaaatggccctgtgtgaatgtggaagaccagcagattggaggtggaattggcctcagtgcttgtcctggaggtggagaagcggtcagagtccttggtggtgaagtggccctgcacaaaacgttgctcccccttggccggtgaaagaataaaagaaagctggccacttgcatttccgtttcagtttatagaatacatgttttggaaatagtatcttctagatctgtctttttctcttctgatttaacttagtaaagctaagttttatctcttcaa

SEQ ID NO: 359666 - DNA, 2199 bp, Homo sapiens
ctgacaagacagaaagagagctgggttgaggtcggggcggattcagagcccaccgtgtcagcaaagacacataaggaactcgccctccggaaagacgcgggggaattctgggagtgcgcggccttggagcgcgacatgcgcggcagctcccgctgctgaatagctgagaggcgcacccgggcggccagctgggctcggagtgcagcggggttaggatggacgaggacgtgttgcaccctgaagagcctcatcatcgcctgctcttgaggttcacagatgatacctttgatccagaacttgcagcaacaatagacaatgcaggaatcacatgaacctgtccatccacagataaagtggtaaagaaactgccgtattagatacatgatggtatactcttcagccataaagcttcgggaaaccctgtcatccgcaaccacgtggagaaacctgtccatccacagatgaagggatcaggaagctctggtatatatactgaagggaaatgctttttggctaccaaaataatgaaattttgttgtttggagcaacacagatgaacctgtccatccacaaatgaagacatcaagaaactctagtatgtacacaaggcaaaacacttcagctatcaaaatcatgacattatgtcacttggagcaacacagttgacccgccaaggcagcctcttcctccatagatggatgaacgctgtggccgctgctcctgcctgggccatgccctgatgctgccaacaccactgctcctctatttataagtcttagtagagttgctgacccagcaataactgaacagctgatatgtacctcacactaagccaggcgcttcatatgtatctaacttgaaaaatgctgagctagttaccttaacaccattaacttttacttaaaagtttgtttttcttttttaatcccagtgagctccaaacaagttttaggaggctccccaaaaccagtgaagactttaactaaaagtagaatttcaaagtattagaaaccaaaccccaaaattaaatgtgaagatcagtgtctgtactgagctggcccatctggtggacacaggatttgcgttatcgactgcaatgttacccaggattcacgatttctagcatctgtcagggttaagaaaattggattgagtaccaaatacagcagagcaaacccggctttgaggcaagggccccatcaagtagtcatgcagtacttttgttagggttctgggtgcaaatcttcctcgtccctcccaccttctcctgggcctccttgtaaacccaaaccgccaggtaccttcaatttttctttcaagaccaggctgttcttaatgttggtaaattggtcaaggaaatgggtgagccactgcttgctctgcacatcgtcctcagagtgctcggtcttcaggcagtacagcagctgcatggctttggcctgcaggagtaagtggcccattcctaggctgtccccaaagatgtgtcctctgaagaagctggtcaggtagagggggtgtccactatggttatagatggggaaggagatgctgcccaggtcgagcgttttgtccacctgccaggtgtacaggagtgggttgggggcaccacgcagagcatcttgtacctcgcgcacacctgctggtactggagctggcttgcgtttccctgtgccacacgcagatcctgcactgtactgtccagtcaactgacttcagcaaagatgtctgggttcagcagcgagttgctgtgtgaggccaccagaatggaggtgatatcggcctcagtgctcatcctggaggtggagaagtggtcagagtcctctgtggtgaaatggccctacaccaaagtgggagacattcagaatcgaggcgaaattggcctcagtgctcctcttggaggcagagaagcagtaggagtcggtggtgaaatggccctgtgtgaatgtggaagaccagcagattggaggtggaattggcctcagtgcttgtcctggaggtggagaagcggtcagagtccttggtggtgaagtggccctgcacaaaacgttgctcccccttggccggtgaaagaataaaagaaagctggccacttgcatttccgtttcagtttatagaatacatgttttggaaatagtatcttctagatctgtctttttctcttctgatttaacttagtaaagctaagttttatctcttcaa

SEQ ID NO: 359667 - DNA, 2120 bp, Homo sapiens
ctgacaagacagaaagagagctgggttgaggtcggggcggattcagagcccaccgtgtcagcaaagacacataaggaactcgccctccggaaagacgcgggggaattctgggagtgcgcggccttggagcgcgacatgcgcggcagctcccgctgctgaatagctgagaggcgcacccgggcggccagctgggctcggagtgcagcggggttaggatggacgaggacgtgttgcaccctgaagagcctcatcatcggtgagagtggggtgggcaagtccagcctgctcttgaggttcacagatgatacctttgatccagaacttgcagcaacaatagacaatgcaggaatcacatgaacctgtccatccacagataaagtggtaaagaaactgccgtattagatacatgatggtatactcttcagccataaagcttcgggaaaccctgtcatccgcaaccacgtggagaaacctgtccatccacagatgaagggatcaggaagctctggtatatatactgaagggaaatgctttttggctaccaaaataatgaaattttgttgtttggagcaacacagatgaacctgtccatccacaaatgaagacatcaagaaactctagtatgtacacaaggcaaaacacttcagctatcaaaatcatgacattatgtcacttggagcaacacagttgacccgccaaggcagcctcttcctccatagatggatgaacgctgtggccgctgctcctgcctgggccatgccctgatgctgccaacaccactgctcctctatttataagtcttagtagagttgctgacccagcaataactgaacagctgatatgtacctcacactaagccaggcgcttcatatgtatctaacttgaaaaatgctgagctagttaccttaacaccattaacttttacttaaaagtttgtttttcttttttaatcccagtgagctccaaacaagttttaggaggctccccaaaaccagtgaagactttaactaaaagtagaatttcaaagtattagaaaccaaaccccaaaattaaatgtgaagatcagtgtctgtactgagctggcccatctggtggacacaggatttgcgttatcgactgcaatgttacccaggattcacgatttctagcatctgtcagggttaagaaaattggattgagtaccaaatacagcagagcaaacccggctttgaggcaagggccccatcaagtagtcatgcagtacttttgttagggttctgggtgcaaatcttcctcgtccctcccaccttctcctgggcctccttgtaaacccaaaccgccaggtaccttcaatttttctttcaagaccaggctgttcttaatgttggtaaattggtcaaggaaatgggtgagccactgcttgctctgcacatcgtcctcagagtgctcggtcttcaggcagtacagcagctgcatggctttggcctgcaggagtaagtggcccattcctaggctgtccccaaagatgtgtcctctgaagaagctggtcaggtagagggggtgtccactatggttatagatggggaaggagatgctgcccaggtcgagcgttttgtccacctgccaggtgtacaggagtgggttgggggcaccacgcagagcatcttgtacctcgcgcacacctgctggtactggagctggcttgcgtttccctgtgccacacgcagatcctgcactgtactgtccagtcaactgacttcagcaaagatgtctgggttcagcagcgagttgctgtgtgaggccaccagaatggaggtgatatcggcctcagtgctcatcctggaggtggagaagtggtcagagtcctctgtggtgaaatggccctacaccaaagtgggagacattcagaatcgaggcgaaattggcctcagtgctcctcttggaggcagagaagcagtaggagtcggtggtgaaatggccctgtgtgaatgtggaagaccagcagattggaggtggaattggcctcagtgcttgtcctggaggtggagaagcggtcagagtccttggtggtgaagtggccctgcacaaaacgttgctcccccttggccggtgaaagaataaaagaaagctggccacttgca

SEQ ID NO: 359668 - DNA, 1883 bp, Homo sapiens
acttggtttgcttgcttacttgacatttgaggtgcacaaggatgtgagtatagcgtattagatacatgatggtatactcttcagccataaagcttcgggaaaccctgtcatccgcaaccacgtggagaaacctgtccatccacagatgaagggatcaggaagctctggtatatatactgaagggaaatgctttttggctaccaaaataatgaaattttgttgtttggagcaacacagatgaacctgtccatccacaaatgaagacatcaagaaactctagtatgtacacaaggcaaaacacttcagctatcaaaatcatgacattatgtcacttggagcaacacagttgacccgccaaggcagcctcttcctccatagatggatgaacgctgtggccgctgctcctgcctgggccatgccctgatgctgccaacaccactgctcctctatttataagtcttagtagagttgctgacccagcaataactgaacagctgatatgtacctcacactaagccaggcgcttcatatgtatctaacttgaaaaatgctgagctagttaccttaacaccattaacttttacttaaaagtttgtttttcttttttaatcccagtgagctccaaacaagttttaggaggctccccaaaaccagtgaagactttaactaaaagtagaatttcaaagtattagaaaccaaaccccaaaattaaatgtgaagatcagtgtctgtactgagctggcccatctggtggacacaggatttgcgttatcgactgcaatgttacccaggattcacgatttctagcatctgtcagggttaagaaaattggattgagtaccaaatacagcagagcaaacccggctttgaggcaagggccccatcaagtagtcatgcagtacttttgttagggttctgggtgcaaatcttcctcgtccctcccaccttctcctgggcctccttgtaaacccaaaccgccaggtaccttcaatttttctttcaagaccaggctgttcttaatgttggtaaattggtcaaggaaatgggtgagccactgcttgctctgcacatcgtcctcagagtgctcggtcttcaggcagtacagcagctgcatggctttggcctgcaggagtaagtggcccattcctaggctgtccccaaagatgtgtcctctgaagaagctggtcaggtagagggggtgtccactatggttatagatggggaaggagatgctgcccaggtcgagcgttttgtccacctgccaggtgtacaggagtgggttgggggcaccacgcagagcatcttgtacctcgcgcacacctgctggtactggagctggcttgcgtttccctgtgccacacgcagatcctgcactgtactgtccagtcaactgacttcagcaaagatgtctgggttcagcagcgagttgctgtgtgaggccaccagaatggaggtgatatcggcctcagtgctcatcctggaggtggagaagtggtcagagtcctctgtggtgaaatggccctacaccaaagtgggagacattcagaatcgaggcgaaattggcctcagtgctcctcttggaggcagagaagcagtaggagtcggtggtgaaatggccctgtgtgaatgtggaagaccagcagattggaggtggaattggcctcagtgcttgtcctggaggtggagaagcggtcagagtccttggtggtgaagtggccctgcacaaaacgttgctcccccttggccggtgaaagaataaaagaaagctggccacttgcatttccgtttcagtttatagaatacatgttttggaaatagtatcttctagatctgtctttttctcttctgatttaacttagtaaagctaagttttatctcttcaa

SEQ ID NO: 359669 - DNA, 1697 bp, Homo sapiens
ctgacaagacagaaagagagctgggttgaggtcggggcggattcagagcccaccgtgtcagcaaagacacataaggaactcgccctccggaaagacgcgggggaattctgggagtgcgcggccttggagcgcgacatgcgcggcagctcccgctgctgaatagctgagaggcgcacccgggcggccagctgggctcggagtgcagcggggttaggatggacgaggacgtgttgcaccctgaagagcctcatcatcggtgagagtggggtgggcaagtccagcctgctcttgaggttcacagatgatacctttgatccagaacttgcagcaacaatagatccatcttcggttgtgaatccggcccggaatgcagccaccccttagagcaaccccccttgctgctcgtgccctgctgtgctactgcctcagtcacttcctgcttggtcaagaccacagctgctgatgtcacagctgaggcacatcagaaaggctgcctgattcaaagaaagctgccggataaatcatagagcacagacacttctacctcatgctcttatgggactttaggaaccaaacataagcacctatggaaaatgcacggcggtcttgaaaggctgtggtctttatcagaaaatatctgaatgactgtttgttatgtcagtcctactctgcaggcttgctaagatgatgattgaaagggctcttggtttctgctttggaatctggcatttatgttttgaagcgttgtgagcaagcgatgtggcagattgcagggtgagggggacaaacctgggccaggagccaggggtttctctacccccttccctgacttacagctggaactgggctcagtggtttcagcctcatttgctaagaaggtctgggtatgtaatcctggctgcatcttaaaaatccctaggagcttttaagacatattgacacataagctctaactcacatgaaacgaaaacacatctctggggctgggctgagcaaatgcattttttaaaaggcccctcaggtgattctgtctcagagatgttgaaaaccagtgggttaggagctcagtcatccactttcagatctgtgattatgccactattaaatacagttggctatcacatagattttatgctttagcttgttcttttttcctttgctataccaaataaaatcttctgagctgtagttccagtccttaaaataatggttgttaccatactgaggttaaacattagtgcatttgcttaacaaggactttaaaacttatcacactgccataatttttaatggtttctataatgattaattaataagaaaatcaataattggattttaagcaggaaactaggcaggaaagttgaaattcatagaccaattcaatggaaaacattaaaatgtattgggagatgcccaatattctatgctgtttggtggttcactggtttctaatctattataacggcacccatagttaaaaagcactagtttttttttggtctgatagttgaaaaaacaacaatcctttgcacgtaggaattattttttccaacatcataatttctgactttgcacatattctattgaattgccaaaatgactttaaagagtctagtacatgcagggaatattacaattgcaatcattattttaacaccatctcctccccctcttcccttcccaaaagatataaagac

SEQ ID NO: 359670 - DNA, 1588 bp, Homo sapiens
tgtgcacttatttctaggccactggccagggcagcagacaggagagcacagagagataggaaagaaaacggcatagctccacccggaggtcttgtgtggccttaggatttcaaaatttacactgtccccaagaacacaggtattttagataaaggcagagctgagaagatacacgtgctgcagagggcgtagccctggaataacatgcacgatctctcatccctccagatccatcttcggttgtgaatccggcccggaatgcagccaccccttagagcaaccccccttgctgctcgtgccctgctgtgctactgcctcagtcacttcctgcttggtcaagaccacagctgctgatgtcacagctgaggcacatcagaaaggctgcctgattcaaagaaagctgccggataaatcatagagcacagacacttctacctcatgctcttatgggactttaggaaccaaacataagcacctatggaaaatgcacggcggtcttgaaaggctgtggtctttatcagaaaatatctgaatgactgtttgttatgtcagtcctactctgcaggcttgctaagatgatgattgaaagggctcttggtttctgctttggaatctggcatttatgttttgaagcgttgtgagcaagcgatgtggcagattgcagggtgagggggacaaacctgggccaggagccaggggtttctctacccccttccctgacttacagctggaactgggctcagtggtttcagcctcatttgctaagaaggtctgggtatgtaatcctggctgcatcttaaaaatccctaggagcttttaagacatattgacacataagctctaactcacatgaaacgaaaacacatctctggggctgggctgagcaaatgcattttttaaaaggcccctcaggtgattctgtctcagagatgttgaaaaccagtgggttaggagctcagtcatccactttcagatctgtgattatgccactattaaatacagttggctatcacatagattttatgctttagcttgttcttttttcctttgctataccaaataaaatcttctgagctgtagttccagtccttaaaataatggttgttaccatactgaggttaaacattagtgcatttgcttaacaaggactttaaaacttatcacactgccataatttttaatggtttctataatgattaattaataagaaaatcaataattggattttaagcaggaaactaggcaggaaagttgaaattcatagaccaattcaatggaaaacattaaaatgtattgggagatgcccaatattctatgctgtttggtggttcactggtttctaatctattataacggcacccatagttaaaaagcactagtttttttttggtctgatagttgaaaaaacaacaatcctttgcacgtaggaattattttttccaacatcataatttctgactttgcacatattctattgaattgccaaaatgactttaaagagtctagtacatgcagggaatattacaattgcaatcattattttaacaccatctcctccccctcttcccttcccaaaagatataaagac

SEQ ID NO: 359671 - DNA, 1040 bp, Homo sapiens
ctgacaagacagaaagagagctgggttgaggtcggggcggattcagagcccaccgtgtcagcaaagacacataaggaactcgccctccggaaagacgcgggggaattctgggagtgcgcggccttggagcgcgacatgcgcggcagctcccgctgctgaatagctgagaggcgcacccgggcggccagctgggctcggagtgcagcggggttaggatggacgaggacgtgttgcaccctgaagagcctcatcatcgcctgctcttgaggttcacagatgatacctttgatccagaacttgcagcaacaataggtaccaaccttcgccttttctatgacgtttgcaaactctcctacccacaggaagcagcagtggggagagagcaggaggaagcagtccccactgttgagcgccgaagctcgaggttccaccagcctggtctgcacatgtcttcttcctgaacacgaggcagacagtcaccgtctttccagacagaacggggataggacgcaccccatatcggaagcatccctgctgcggacgctttcacttctaaagagtcttgtctgctaataagagtgcccatggcccagggtggcagcagggggatttagaaagggcatgatgatggcactagcggctgctttcctggtttgtgctttcccaaatgtcacccacttctcaggaccattatcagtgtcatgtgcgtgggttaatgaaggctcccccttccagggagatgagcacacaggctccttttccctccttcactcttctcccggggcctttctctcccctggccacctcctgcacccaattacatctgtggcccaggcaagggaagccacgccttcaggaagggtcggctcttcccctggggagtttccactatgaaccctaggggcctctcaacaggaaggatggaggcgccaccttctgtggctttcaacaccttttcctaaatatttgttgattttgagctttccacaattaaacagatcatgtagtctctgggttaggactcaggacagagattggtt

SEQ ID NO: 359672 - DNA, 2266 bp, Homo sapiens
ctgacaagacagaaagagagctgggttgaggtcggggcggattcagagcccaccgtgtcagcaaagacacataaggaactcgccctccggaaagacgcgggggaattctgggagtgcgcggccttggagcgcgacatgcgcggcagctcccgctgctgaatagctgagaggcgcacccgggcggccagctgggctcggagtgcagcggggttaggatggacgaggacgtgttgcaccctgaagagcctcatcatcggtgagagtggggtgggcaagtccagcctgctcttgaggttcacagatgatacctttgatccagaacttgcagcaacaatagacaatgcaggaatcacatgaacctgtccatccacagataaagtggtaaagaaactgccgtattagatacatgatggtatactcttcagccataaagcttcgggaaaccctgtcatccgcaaccacgtggagaaacctgtccatccacagatgaagggatcaggaagctctggtatatatactgaagggaaatgctttttggctaccaaaataatgaaattttgttgtttggagcaacacagatgaacctgtccatccacaaatgaagacatcaagaaactctagtatgtacacaaggcaaaacacttcagctatcaaaatcatgacattatgtcacttggagcaacacagttgacccgccaaggcagcctcttcctccatagatggatgaacgctgtggccgctgctcctgcctgggccatgccctgatgctgccaacaccactgctcctctatttataagtcttagtagagttgctgacccagcaataactgaacagctgatatgtacctcacactaagccaggcgcttcatatgtatctaacttgaaaaatgctgagctagttaccttaacaccattaacttttacttaaaagtttgtttttcttttttaatcccagtgagctccaaacaagttttaggaggctccccaaaaccagtgaagactttaactaaaagtagaatttcaaagtattagaaaccaaaccccaaaattaaatgtgaagatcagtgtctgtactgagctggcccatctggtggacacaggatttgcgttatcgactgcaatgttacccaggattcacgatttctagcatctgtcagggttaagaaaattggattgagtaccaaatacagcagagcaaacccggctttgaggcaagggccccatcaagtagtcatgcagtacttttgttagggttctgggtgcaaatcttcctcgtccctcccaccttctcctgggcctccttgtaaacccaaaccgccaggtaccttcaatttttctttcaagaccaggctgttcttaatgttggtaaattggtcaaggaaatgggtgagccactgcttgctctgcacatcgtcctcagagtgctcggtcttcaggcagtacagcagctgcatggctttggcctgcaggagtaagtggcccattcctaggctgtccccaaagatgtgtcctctgaagaagctggtcaggtagagggggtgtccactatggttatagatggggaaggagatgctgcccaggtcgagcgttttgtccacctgccaggtgtacaggagtgggttgggggcaccacgcagagcatcttgtacctcgcgcacacctgctggtactggagctggcttgcgtttccctgtgccacacgcagatcctgcactgtactgtccagtcaactgacttcagcaaagatgtctgggttcagcagcgagttgctgtgtgaggccaccagaatggaggtgatatcggcctcagtgctcatcctggaggtggagaagtggtcagagtcctctgtggtgaaatggccctacaccaaagtgggagacattcagaatcgaggcgaaattggcctcagtgctcctcttggaggcagagaagcagtaggagtcggtggtgaaatggccctgtgtgaatgtggaagaccagcagattggaggtggaattggcctcagtgcttgtcctggaggtggagaagcggtcagagtccttggtggtgaagtggccctgcacaaaacgttgctcccccttggccggtgaaagaataaaagaaagctggccacttgcatttccgtttcagtttatagaatacatgttttggaaatagtatcttctagatctgtctttttctcttctgatttaacttagtaaagctaagttttatctcttcaaaaaaaaagagagagagtgagaaagaaagaaagaaagaaagaa

SEQ ID NO: 359673 - DNA, 4058 bp, Homo sapiens
  misc_feature (2614)..(2614): n is a, c, g, or t
  misc_feature (3277)..(3277): n is a, c, g, or t
  misc_feature (3639)..(3639): n is a, c, g, or t
cccatgctgagggctaggctggatgaggctgggttgttacaggggtcccagaagctctcctgtattaggtacagaccaggaagtggctggcttaagagcacagagctgggatcaaactttattaaaacacactggcccaccccaccaggcatgtagattctcagagcaagcaaacaagacatactaaaacatacaaatgcataactcattttcctggtgtttcaaatatttattttaggtagtaaaggcttttgtcgttctaaatcctgattacaagtcacatgatcaagaacaactaataaaggagattcaggagcatgttaaaaaaactacagcaccttacaaatatcccagaaaggtaggcatcctaattataacgaatatttgctcagtgttgtggacaatttcaagtgtttatttttacattttaatgaatattttcttcacacatgctgcaccacatgtcccaaactgaactgatgacatatgggtaagaatcagaatctttgagattaaaatgaaaccctgaacctattttgtttggtcctttggcttactggactcacagtaaatacttaatatcaagacaactttcctaacaatacccttttccctattttggctgttacccaaaacccattccaaagactattctaattcttccacctagaattcataatcaaactgctatataattggctttatgtaaagataaaaatttccaggctaattttcttccccttgatgccaacaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctccacattagtgtcaatgttcctatcatttcttaatataaaaataataccatcaattgctgattaatttttaaatgtatagtatagaagcagtttctgaaccagatctctgctacataggttttcaaactttagttgactaattcttctgatatgttgatatacaaatcagaaccaatgttcaagcctgaaataaaactaaagaacttataaaagtttttagaaaaatataaaatatcagttagaagattatgataatctcaaagtacaagaatctacctgaaaatagactagggatttttattagtcacattttttgcaaataatttaaaaatagtttagacttgtttcaaggtctaactataaaagaaggatcatatactattgttgcttattatatgtaatctaataaatactgtttacaaaagattacacttgtggttcctgaagaaagtatggtaaatgcagtaaacattaatatataaaataaaaataaaatagtgtaagatgttatcagaatactcatgtttggaaattcaaggaacaattaggattcatacatgaaaggttatcaattcctcattgaaggcctgagtctcaaagaatttttggtggaaatacttaaatttctgtcacaaatatggcttgtttctggagaactaaaagtgagtccccctgtggaatgagatggaaccatgctgttggctctttccttttgaagtgtttgttcccatttgaaataaccacaacattttctgttttcttggtatttcccgatagggcaacaatagaagacttttccatggttcggtccattattagaaacaacaagtctcttagatctccgaccacacttgcataatggaggtgtcattttcccactcttccatggctcttgtaggttaactgtagaagttaatatagatgggagacgcctccaggaagaacttcttactggggagcaatcagatgatgtaggcttttcttcatgaatagtgaagggttgtttttttgctggtgggaaagcttggggactgcatggattccttttggtaccacctgaaagaagaggatgtttccccaaaactaaaggatgagacatattggcattaactctgttgaaggtacttgatttgtgttcaggtaacttaaaggcagaaatatctgaacctggatctttggcttcttttacattataaatagtagtgtgaggactcttgtacacaatagacttagaagtctcagatttttgaggagtttcctctatgtctccaaagttttcatgacttgacatttccaattctttcaaaaccattaatctttctccagaattaaatgaaatctctaagtctgagtcactaatgggaactgtacagtctacgttttcctcaggctgagatgctggcagtaaaaccacatcctcccaatcagccaacacaggtaaacagtccagagtagagctcatttccaaatcagaaacatgatgaacagttggaacggtggtagaaacaagtaccaattctgaaccaactgttgaagccttagatttggtattaaatgcaagatgttcattttttccttgcttttgcatanagataggtgaattcaaggtaggagactgcaactgccccacagaagtagaggacttagtattaaaaagaggtaaggaacttttgacattgtgaagacttgcttttatattgttttttacttgtaattgatcctgttgtgcctttataggagaatttgcacaaattgacttcatttgaactttttcatgaggatttattatatttttaggctccttattatatatgctgggaccctggatgctaatgttacaggcagacatttcttcaacttgaattgtattcaaatttctggccagaatgctgaaattcttcttagtgggaacctatgattccacagacaaatgcaacagctttagaaactgtgcattcgttaatttcttcagtatacagttttatgacaaaaaagagaaatgtcattgatttataaatgactgcacacattaaatctacgtttcaaagaacgtatgactgtttatgaagtttgagatgacagaataaaaaggcaagacactactaaccttgttcaacgaccttgtaattttcattacacaaccatctctgatcattttccaagcaagaagggcagtattccgagaatcgtccaaccctgaggatacagatatcaaacactgaatttagtggtactagtactatttccttagtnctaaagaaataacttaaaaagaaaaacaccacttgtgtagaaattggaacacagttttagttttatgaccatctactaattttaatcatgataaactggtcttggaagtggaaggctatggcagcattaccagtgaaagacaagctcgtccacatttatagaggaggatatgaaaatgtattagacagttccccaaaatgtggccagcgttctgcaggaaccaggatttgtgaataatctaatagtcttgttcagttttttcactagtccattctattatttgagcacttgtttaatctccatttgatttggctcattcttttcattcttcttagcaactagaaagccactagatggcagtntatcttacaatagtttatgaaagtggtaatttgaaagtcttagaaacaatgtgaattgtttagattaggagttttttttttttaggctgaagatatcccttactaatgacattaccaaaaaatgaaattcatatgaagtattttttaaaagtcaaatggcttacataatttttaatgtatactaaccagaatgttctcgtcctgagaattctattcctacttcctgcaaggcaccacttagtccttttggttttctcctatagaaaagctaaccaataaaaaaagatatatttaaaagaagattactattttaaagactatgtattaaacacttttcataatttttagttctattagatttagaatgtgcttattttttgtgtgttgtttttaaatactttaagaaatgcatttatgtg

SEQ ID NO: 359674 - DNA, 1575 bp, Homo sapiens
cggattgtcagactgctcctccctcttctttagactgccacgaggaaaaagcagatgtgagaactcaaggttcagggctgctcttctaagaaacaagtctgccataatctccatctgtgttggaatctgttaactaatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaaacatgccagtgacagccacacctgtgtgaagacaaaacacaatgagatcatggccatattctttaccagtggaacaagtggatatccgaaaatgactgcacacacccacagcagttttggtttaggattatctgtaaatggaaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaaacactctccaagtaccccatcacagtcttctgttcagcaccaactgtataccgaatgcttgtacagaatgatataaccagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaaggtttgcacatccccttccaggagaatgtttaacaacccaatctgtacactacctacctaccgcttacccccatataaactttctttgttatgatggtgattccattttacttccatgatactttaatttttataaatatgtgaaaatgattagaaatgttagct

SEQ ID NO: 359675 - DNA, 454 bp, Homo sapiens
cggcggcccccccccgggcattgacttgtttttcccaccaccgccgggattttcgagtggatggtagtaaaggcttttgtcgttctaaatcctgattacaagtcacatgatcaagaacaactaataaaggagattcaggagcatgttaaaaaaactacagcaccttacaaatatcccagaaaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctcc

SEQ ID NO: 359676 - DNA, 2133 bp, Homo sapiens
cggattgtcagactgctcctccctcttctttagactgccacgaggaaaaagcagatgtgagaactcaaggttcagggctgctcttctaagaaacaagtctgccataatctccatctgtgttggaatctgttaactaatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaaacatgccagtgacagccacacctgtgtgaagacaaaacacaatgagatcatggccatattctttaccagtggaacaagtggatatccgaaaatgactgcacacacccacagcagttttggtttaggattatctgtaaatggaaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaaacactctccaagtaccccatcacagtcttctgttcagcaccaactgtataccgaatgcttgtacagaatgatataaccagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaagattgtagatgtaaatggcaatgttctacctcctggacaagaaggagatattggcattcaagttctacccaaccgaccatttggcctttttactcattacgtagataatccttcaaaaacagcttcaactctacgaggcaatttctatatcactggggacagaggatatatggataaagatgggtatttctggtttgttgcaagagcagatgatgtcatattatcctctggctatcgaattggaccatttgaggtagaaaatgccctgaatgaacacccttcagttgcagagtcagctgttgtcagcagcccagaccccatcagaggagagggtagtaaaggcttttgtcgttctaaatcctgattacaagtcacatgatcaagaacaactaataaaggagattcaggagcatgttaaaaaaactacagcaccttacaaatatcccagaaaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctcc

SEQ ID NO: 359677 - DNA, 4697 bp, Homo sapiens
  misc_feature (3253)..(3253): n is a, c, g, or t
  misc_feature (3916)..(3916): n is a, c, g, or t
  misc_feature (4278)..(4278): n is a, c, g, or t
cgtgtctctgcttgtttgactttctgttctgctgtttcttccctgctgctggcggtggccgtctgtgcctcgcgctgtggtatgtatgtgctggcgccatttgatttcttcggctctgtctctgcctctgctttgtgtcttgtctacgtgctcttggtgttttgtcgctttgtgcgtgctatgtgcgttgtggggcctgctcattcttgtgcccctggtgttcgggctctgtgcttctgctggtgcgtctttgtcgttcgtgctcttgttgttgcttctcctgtctgtttctttgtcgtttatggtctgtcgccgctcgtctttctgtttgtccgcttctcgtctttccccccgtgtttgccgctctcttgggcctcttgctcctcgctggttttgtttgctcgtttgtgcttttcgtcgtttgcttctggtgtgtctgcttttgtctgttgtcgttgtgctgttgttgtttgtgtggtgttgttctgctgtattgtttgttccgtttctccccccgcgcggggccttacattttgatatttcgagtgcttcgtctctgtggactcccccgttggattagtgatccccccttagtgggcctcccggaacgtcactgctggagtttgtttcacgaaaccgcttctgttgtccccccgggcgtttgtttaattttggtgagagagaattcccgcccccgtttgttcactgcgccccgattctccctctagtggaaccaccgctagtggcccctcgttgcacacttagcctcatctggggcccccgcgcgcccccaccgccatggttctaagaaaactttctctcgcgggggccgcgcgggcgcgccccacacacacgtttttttttttttttttttttggtagtaaaggcttttgtcgttctaaatcctgattacaagtcacatgatcaagaacaactaataaaggagattcaggagcatgttaaaaaaactacagcaccttacaaatatcccagaaaggtaggcatcctaattataacgaatatttgctcagtgttgtggacaatttcaagtgtttatttttacattttaatgaatattttcttcacacatgctgcaccacatgtcccaaactgaactgatgacatatgggtaagaatcagaatctttgagattaaaatgaaaccctgaacctattttgtttggtcctttggcttactggactcacagtaaatacttaatatcaagacaactttcctaacaatacccttttccctattttggctgttacccaaaacccattccaaagactattctaattcttccacctagaattcataatcaaactgctatataattggctttatgtaaagataaaaatttccaggctaattttcttccccttgatgccaacaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctccacattagtgtcaatgttcctatcatttcttaatataaaaataataccatcaattgctgattaatttttaaatgtatagtatagaagcagtttctgaaccagatctctgctacataggttttcaaactttagttgactaattcttctgatatgttgatatacaaatcagaaccaatgttcaagcctgaaataaaactaaagaacttataaaagtttttagaaaaatataaaatatcagttagaagattatgataatctcaaagtacaagaatctacctgaaaatagactagggatttttattagtcacattttttgcaaataatttaaaaatagtttagacttgtttcaaggtctaactataaaagaaggatcatatactattgttgcttattatatgtaatctaataaatactgtttacaaaagattacacttgtggttcctgaagaaagtatggtaaatgcagtaaacattaatatataaaataaaaataaaatagtgtaagatgttatcagaatactcatgtttggaaattcaaggaacaattaggattcatacatgaaaggttatcaattcctcattgaaggcctgagtctcaaagaatttttggtggaaatacttaaatttctgtcacaaatatggcttgtttctggagaactaaaagtgagtccccctgtggaatgagatggaaccatgctgttggctctttccttttgaagtgtttgttcccatttgaaataaccacaacattttctgttttcttggtatttcccgatagggcaacaatagaagacttttccatggttcggtccattattagaaacaacaagtctcttagatctccgaccacacttgcataatggaggtgtcattttcccactcttccatggctcttgtaggttaactgtagaagttaatatagatgggagacgcctccaggaagaacttcttactggggagcaatcagatgatgtaggcttttcttcatgaatagtgaagggttgtttttttgctggtgggaaagcttggggactgcatggattccttttggtaccacctgaaagaagaggatgtttccccaaaactaaaggatgagacatattggcattaactctgttgaaggtacttgatttgtgttcaggtaacttaaaggcagaaatatctgaacctggatctttggcttcttttacattataaatagtagtgtgaggactcttgtacacaatagacttagaagtctcagatttttgaggagtttcctctatgtctccaaagttttcatgacttgacatttccaattctttcaaaaccattaatctttctccagaattaaatgaaatctctaagtctgagtcactaatgggaactgtacagtctacgttttcctcaggctgagatgctggcagtaaaaccacatcctcccaatcagccaacacaggtaaacagtccagagtagagctcatttccaaatcagaaacatgatgaacagttggaacggtggtagaaacaagtaccaattctgaaccaactgttgaagccttagatttggtattaaatgcaagatgttcattttttccttgcttttgcatanagataggtgaattcaaggtaggagactgcaactgccccacagaagtagaggacttagtattaaaaagaggtaaggaacttttgacattgtgaagacttgcttttatattgttttttacttgtaattgatcctgttgtgcctttataggagaatttgcacaaattgacttcatttgaactttttcatgaggatttattatatttttaggctccttattatatatgctgggaccctggatgctaatgttacaggcagacatttcttcaacttgaattgtattcaaatttctggccagaatgctgaaattcttcttagtgggaacctatgattccacagacaaatgcaacagctttagaaactgtgcattcgttaatttcttcagtatacagttttatgacaaaaaagagaaatgtcattgatttataaatgactgcacacattaaatctacgtttcaaagaacgtatgactgtttatgaagtttgagatgacagaataaaaaggcaagacactactaaccttgttcaacgaccttgtaattttcattacacaaccatctctgatcattttccaagcaagaagggcagtattccgagaatcgtccaaccctgaggatacagatatcaaacactgaatttagtggtactagtactatttccttagtnctaaagaaataacttaaaaagaaaaacaccacttgtgtagaaattggaacacagttttagttttatgaccatctactaattttaatcatgataaactggtcttggaagtggaaggctatggcagcattaccagtgaaagacaagctcgtccacatttatagaggaggatatgaaaatgtattagacagttccccaaaatgtggccagcgttctgcaggaaccaggatttgtgaataatctaatagtcttgttcagttttttcactagtccattctattatttgagcacttgtttaatctccatttgatttggctcattcttttcattcttcttagcaactagaaagccactagatggcagtntatcttacaatagtttatgaaagtggtaatttgaaagtcttagaaacaatgtgaattgtttagattaggagttttttttttttaggctgaagatatcccttactaatgacattaccaaaaaatgaaattcatatgaagtattttttaaaagtcaaatggcttacataatttttaatgtatactaaccagaatgttctcgtcctgagaattctattcctacttcctgcaaggcaccacttagtccttttggttttctcctatagaaaagctaaccaataaaaaaagatatatttaaaagaagattactattttaaagactatgtattaaacacttttcataatttttagttctattagatttagaatgtgcttattttttgtgtgttgtttttaaatactttaagaaatgcatttatgtg

SEQ ID NO: 359678 - DNA, 4041 bp, Homo sapiens
  misc_feature (2597)..(2597): n is a, c, g, or t
  misc_feature (3260)..(3260): n is a, c, g, or t
  misc_feature (3622)..(3622): n is a, c, g, or t
tcctagcacacccatcacttgggaaattacaaaggttttagaagctctgggccaggaacccaggatgaagactcagtacagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaagattgtagatgtaaatggcaatgttctacctcctggacaagaaggagatattggcattcaagttctacccaaccgaccatttggcctttttactcattacgtagataatccttcaaaaacagcttcaactctacgaggcaatttctatatcactggggacagaggatatatggataaagatgggtatttctggtttgttgcaagagcagatgatgtcatattatcctctggctatcgaattggaccatttgaggtagaaaatgccctgaatgaacacccttcagttgcagagtcagctgttgtcagcagcccagaccccatcagaggagagggtagtaaaggcttttgtcgttctaaatcctgattacaagtcacatgatcaagaacaactaataaaggagattcaggagcatgttaaaaaaactacagcaccttacaaatatcccagaaaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctccacattagtgtcaatgttcctatcatttcttaatataaaaataataccatcaattgctgattaatttttaaatgtatagtatagaagcagtttctgaaccagatctctgctacataggttttcaaactttagttgactaattcttctgatatgttgatatacaaatcagaaccaatgttcaagcctgaaataaaactaaagaacttataaaagtttttagaaaaatataaaatatcagttagaagattatgataatctcaaagtacaagaatctacctgaaaatagactagggatttttattagtcacattttttgcaaataatttaaaaatagtttagacttgtttcaaggtctaactataaaagaaggatcatatactattgttgcttattatatgtaatctaataaatactgtttacaaaagattacacttgtggttcctgaagaaagtatggtaaatgcagtaaacattaatatataaaataaaaataaaatagtgtaagatgttatcagaatactcatgtttggaaattcaaggaacaattaggattcatacatgaaaggttatcaattcctcattgaaggcctgagtctcaaagaatttttggtggaaatacttaaatttctgtcacaaatatggcttgtttctggagaactaaaagtgagtccccctgtggaatgagatggaaccatgctgttggctctttccttttgaagtgtttgttcccatttgaaataaccacaacattttctgttttcttggtatttcccgatagggcaacaatagaagacttttccatggttcggtccattattagaaacaacaagtctcttagatctccgaccacacttgcataatggaggtgtcattttcccactcttccatggctcttgtaggttaactgtagaagttaatatagatgggagacgcctccaggaagaacttcttactggggagcaatcagatgatgtaggcttttcttcatgaatagtgaagggttgtttttttgctggtgggaaagcttggggactgcatggattccttttggtaccacctgaaagaagaggatgtttccccaaaactaaaggatgagacatattggcattaactctgttgaaggtacttgatttgtgttcaggtaacttaaaggcagaaatatctgaacctggatctttggcttcttttacattataaatagtagtgtgaggactcttgtacacaatagacttagaagtctcagatttttgaggagtttcctctatgtctccaaagttttcatgacttgacatttccaattctttcaaaaccattaatctttctccagaattaaatgaaatctctaagtctgagtcactaatgggaactgtacagtctacgttttcctcaggctgagatgctggcagtaaaaccacatcctcccaatcagccaacacaggtaaacagtccagagtagagctcatttccaaatcagaaacatgatgaacagttggaacggtggtagaaacaagtaccaattctgaaccaactgttgaagccttagatttggtattaaatgcaagatgttcattttttccttgcttttgcatanagataggtgaattcaaggtaggagactgcaactgccccacagaagtagaggacttagtattaaaaagaggtaaggaacttttgacattgtgaagacttgcttttatattgttttttacttgtaattgatcctgttgtgcctttataggagaatttgcacaaattgacttcatttgaactttttcatgaggatttattatatttttaggctccttattatatatgctgggaccctggatgctaatgttacaggcagacatttcttcaacttgaattgtattcaaatttctggccagaatgctgaaattcttcttagtgggaacctatgattccacagacaaatgcaacagctttagaaactgtgcattcgttaatttcttcagtatacagttttatgacaaaaaagagaaatgtcattgatttataaatgactgcacacattaaatctacgtttcaaagaacgtatgactgtttatgaagtttgagatgacagaataaaaaggcaagacactactaaccttgttcaacgaccttgtaattttcattacacaaccatctctgatcattttccaagcaagaagggcagtattccgagaatcgtccaaccctgaggatacagatatcaaacactgaatttagtggtactagtactatttccttagtnctaaagaaataacttaaaaagaaaaacaccacttgtgtagaaattggaacacagttttagttttatgaccatctactaattttaatcatgataaactggtcttggaagtggaaggctatggcagcattaccagtgaaagacaagctcgtccacatttatagaggaggatatgaaaatgtattagacagttccccaaaatgtggccagcgttctgcaggaaccaggatttgtgaataatctaatagtcttgttcagttttttcactagtccattctattatttgagcacttgtttaatctccatttgatttggctcattcttttcattcttcttagcaactagaaagccactagatggcagtntatcttacaatagtttatgaaagtggtaatttgaaagtcttagaaacaatgtgaattgtttagattaggagttttttttttttaggctgaagatatcccttactaatgacattaccaaaaaatgaaattcatatgaagtattttttaaaagtcaaatggcttacataatttttaatgtatactaaccagaatgttctcgtcctgagaattctattcctacttcctgcaaggcaccacttagtccttttggttttctcctatagaaaagctaaccaataaaaaaagatatatttaaaagaagattactattttaaagactatgtattaaacacttttcataatttttagttctattagatttagaatgtgcttattttttgtgtgttgtttttaaatactttaagaaatgcatttatgtg

SEQ ID NO: 359679 - DNA, 3491 bp, Homo sapiens
  misc_feature (26)..(26): n is a, c, g, or t
  misc_feature (28)..(28): n is a, c, g, or t
  misc_feature (47)..(49): n is a, c, g, or t
  misc_feature (52)..(52): n is a, c, g, or t
  misc_feature (2047)..(2047): n is a, c, g, or t
  misc_feature (2710)..(2710): n is a, c, g, or t
  misc_feature (3072)..(3072): n is a, c, g, or t
gccccggagggcccgccccaagcccngnaggtgtttagtcttttggnnnggnccgtccggattggaggtagtaaaggcttttgtcgttctaaatcctgattacaagtcacatgatcaagaacaactaataaaggagattcaggagcatgttaaaaaaactacagcaccttacaaatatcccagaaaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctccacattagtgtcaatgttcctatcatttcttaatataaaaataataccatcaattgctgattaatttttaaatgtatagtatagaagcagtttctgaaccagatctctgctacataggttttcaaactttagttgactaattcttctgatatgttgatatacaaatcagaaccaatgttcaagcctgaaataaaactaaagaacttataaaagtttttagaaaaatataaaatatcagttagaagattatgataatctcaaagtacaagaatctacctgaaaatagactagggatttttattagtcacattttttgcaaataatttaaaaatagtttagacttgtttcaaggtctaactataaaagaaggatcatatactattgttgcttattatatgtaatctaataaatactgtttacaaaagattacacttgtggttcctgaagaaagtatggtaaatgcagtaaacattaatatataaaataaaaataaaatagtgtaagatgttatcagaatactcatgtttggaaattcaaggaacaattaggattcatacatgaaaggttatcaattcctcattgaaggcctgagtctcaaagaatttttggtggaaatacttaaatttctgtcacaaatatggcttgtttctggagaactaaaagtgagtccccctgtggaatgagatggaaccatgctgttggctctttccttttgaagtgtttgttcccatttgaaataaccacaacattttctgttttcttggtatttcccgatagggcaacaatagaagacttttccatggttcggtccattattagaaacaacaagtctcttagatctccgaccacacttgcataatggaggtgtcattttcccactcttccatggctcttgtaggttaactgtagaagttaatatagatgggagacgcctccaggaagaacttcttactggggagcaatcagatgatgtaggcttttcttcatgaatagtgaagggttgtttttttgctggtgggaaagcttggggactgcatggattccttttggtaccacctgaaagaagaggatgtttccccaaaactaaaggatgagacatattggcattaactctgttgaaggtacttgatttgtgttcaggtaacttaaaggcagaaatatctgaacctggatctttggcttcttttacattataaatagtagtgtgaggactcttgtacacaatagacttagaagtctcagatttttgaggagtttcctctatgtctccaaagttttcatgacttgacatttccaattctttcaaaaccattaatctttctccagaattaaatgaaatctctaagtctgagtcactaatgggaactgtacagtctacgttttcctcaggctgagatgctggcagtaaaaccacatcctcccaatcagccaacacaggtaaacagtccagagtagagctcatttccaaatcagaaacatgatgaacagttggaacggtggtagaaacaagtaccaattctgaaccaactgttgaagccttagatttggtattaaatgcaagatgttcattttttccttgcttttgcatanagataggtgaattcaaggtaggagactgcaactgccccacagaagtagaggacttagtattaaaaagaggtaaggaacttttgacattgtgaagacttgcttttatattgttttttacttgtaattgatcctgttgtgcctttataggagaatttgcacaaattgacttcatttgaactttttcatgaggatttattatatttttaggctccttattatatatgctgggaccctggatgctaatgttacaggcagacatttcttcaacttgaattgtattcaaatttctggccagaatgctgaaattcttcttagtgggaacctatgattccacagacaaatgcaacagctttagaaactgtgcattcgttaatttcttcagtatacagttttatgacaaaaaagagaaatgtcattgatttataaatgactgcacacattaaatctacgtttcaaagaacgtatgactgtttatgaagtttgagatgacagaataaaaaggcaagacactactaaccttgttcaacgaccttgtaattttcattacacaaccatctctgatcattttccaagcaagaagggcagtattccgagaatcgtccaaccctgaggatacagatatcaaacactgaatttagtggtactagtactatttccttagtnctaaagaaataacttaaaaagaaaaacaccacttgtgtagaaattggaacacagttttagttttatgaccatctactaattttaatcatgataaactggtcttggaagtggaaggctatggcagcattaccagtgaaagacaagctcgtccacatttatagaggaggatatgaaaatgtattagacagttccccaaaatgtggccagcgttctgcaggaaccaggatttgtgaataatctaatagtcttgttcagttttttcactagtccattctattatttgagcacttgtttaatctccatttgatttggctcattcttttcattcttcttagcaactagaaagccactagatggcagtntatcttacaatagtttatgaaagtggtaatttgaaagtcttagaaacaatgtgaattgtttagattaggagttttttttttttaggctgaagatatcccttactaatgacattaccaaaaaatgaaattcatatgaagtattttttaaaagtcaaatggcttacataatttttaatgtatactaaccagaatgttctcgtcctgagaattctattcctacttcctgcaaggcaccacttagtccttttggttttctcctatagaaaagctaaccaataaaaaaagatatatttaaaagaagattactattttaaagactatgtattaaacacttttcataatttttagttctattagatttagaatgtgcttattttttgtgtgttgtttttaaatactttaagaaatgcatttatgtg

SEQ ID NO: 359680 - DNA, 5166 bp, Homo sapiens
  misc_feature (3722)..(3722): n is a, c, g, or t
  misc_feature (4385)..(4385): n is a, c, g, or t
  misc_feature (4747)..(4747): n is a, c, g, or t
cggattgtcagactgctcctccctcttctttagactgccacgaggaaaaagcagatgtgagaactcaaggttcagggctgctcttctaagaaacaagtctgccataatctccatctgtgttggaatctgttaactaatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaaacatgccagtgacagccacacctgtgtgaagacaaaacacaatgagatcatggccatattctttaccagtggaacaagtggatatccgaaaatgactgcacacacccacagcagttttggtttaggattatctgtaaatggaaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaaacactctccaagtaccccatcacagtcttctgttcagcaccaactgtataccgaatgcttgtacagaatgatataaccagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaagattgtagatgtaaatggcaatgttctacctcctggacaagaaggagatattggcattcaagttctacccaaccgaccatttggcctttttactcattacgtagataatccttcaaaaacagcttcaactctacgaggcaatttctatatcactggggacagaggatatatggataaagatgggtatttctggtttgttgcaagagcagatgatgtcatattatcctctggctatcgaattggaccatttgaggtagaaaatgccctgaatgaacacccttcagttgcagagtcagctgttgtcagcagcccagaccccatcagaggagagggtagtaaaggcttttgtcgttctaaatcctgattacaagtcacatgatcaagaacaactaataaaggagattcaggagcatgttaaaaaaactacagcaccttacaaatatcccagaaaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctccacattagtgtcaatgttcctatcatttcttaatataaaaataataccatcaattgctgattaatttttaaatgtatagtatagaagcagtttctgaaccagatctctgctacataggttttcaaactttagttgactaattcttctgatatgttgatatacaaatcagaaccaatgttcaagcctgaaataaaactaaagaacttataaaagtttttagaaaaatataaaatatcagttagaagattatgataatctcaaagtacaagaatctacctgaaaatagactagggatttttattagtcacattttttgcaaataatttaaaaatagtttagacttgtttcaaggtctaactataaaagaaggatcatatactattgttgcttattatatgtaatctaataaatactgtttacaaaagattacacttgtggttcctgaagaaagtatggtaaatgcagtaaacattaatatataaaataaaaataaaatagtgtaagatgttatcagaatactcatgtttggaaattcaaggaacaattaggattcatacatgaaaggttatcaattcctcattgaaggcctgagtctcaaagaatttttggtggaaatacttaaatttctgtcacaaatatggcttgtttctggagaactaaaagtgagtccccctgtggaatgagatggaaccatgctgttggctctttccttttgaagtgtttgttcccatttgaaataaccacaacattttctgttttcttggtatttcccgatagggcaacaatagaagacttttccatggttcggtccattattagaaacaacaagtctcttagatctccgaccacacttgcataatggaggtgtcattttcccactcttccatggctcttgtaggttaactgtagaagttaatatagatgggagacgcctccaggaagaacttcttactggggagcaatcagatgatgtaggcttttcttcatgaatagtgaagggttgtttttttgctggtgggaaagcttggggactgcatggattccttttggtaccacctgaaagaagaggatgtttccccaaaactaaaggatgagacatattggcattaactctgttgaaggtacttgatttgtgttcaggtaacttaaaggcagaaatatctgaacctggatctttggcttcttttacattataaatagtagtgtgaggactcttgtacacaatagacttagaagtctcagatttttgaggagtttcctctatgtctccaaagttttcatgacttgacatttccaattctttcaaaaccattaatctttctccagaattaaatgaaatctctaagtctgagtcactaatgggaactgtacagtctacgttttcctcaggctgagatgctggcagtaaaaccacatcctcccaatcagccaacacaggtaaacagtccagagtagagctcatttccaaatcagaaacatgatgaacagttggaacggtggtagaaacaagtaccaattctgaaccaactgttgaagccttagatttggtattaaatgcaagatgttcattttttccttgcttttgcatanagataggtgaattcaaggtaggagactgcaactgccccacagaagtagaggacttagtattaaaaagaggtaaggaacttttgacattgtgaagacttgcttttatattgttttttacttgtaattgatcctgttgtgcctttataggagaatttgcacaaattgacttcatttgaactttttcatgaggatttattatatttttaggctccttattatatatgctgggaccctggatgctaatgttacaggcagacatttcttcaacttgaattgtattcaaatttctggccagaatgctgaaattcttcttagtgggaacctatgattccacagacaaatgcaacagctttagaaactgtgcattcgttaatttcttcagtatacagttttatgacaaaaaagagaaatgtcattgatttataaatgactgcacacattaaatctacgtttcaaagaacgtatgactgtttatgaagtttgagatgacagaataaaaaggcaagacactactaaccttgttcaacgaccttgtaattttcattacacaaccatctctgatcattttccaagcaagaagggcagtattccgagaatcgtccaaccctgaggatacagatatcaaacactgaatttagtggtactagtactatttccttagtnctaaagaaataacttaaaaagaaaaacaccacttgtgtagaaattggaacacagttttagttttatgaccatctactaattttaatcatgataaactggtcttggaagtggaaggctatggcagcattaccagtgaaagacaagctcgtccacatttatagaggaggatatgaaaatgtattagacagttccccaaaatgtggccagcgttctgcaggaaccaggatttgtgaataatctaatagtcttgttcagttttttcactagtccattctattatttgagcacttgtttaatctccatttgatttggctcattcttttcattcttcttagcaactagaaagccactagatggcagtntatcttacaatagtttatgaaagtggtaatttgaaagtcttagaaacaatgtgaattgtttagattaggagttttttttttttaggctgaagatatcccttactaatgacattaccaaaaaatgaaattcatatgaagtattttttaaaagtcaaatggcttacataatttttaatgtatactaaccagaatgttctcgtcctgagaattctattcctacttcctgcaaggcaccacttagtccttttggttttctcctatagaaaagctaaccaataaaaaaagatatatttaaaagaagattactattttaaagactatgtattaaacacttttcataatttttagttctattagatttagaatgtgcttattttttgtgtgttgtttttaaatactttaagaaatgcatttatgtg

SEQ ID NO: 359681 - DNA, 4938 bp, Homo sapiens
  misc_feature (3494)..(3494): n is a, c, g, or t
  misc_feature (4157)..(4157): n is a, c, g, or t
  misc_feature (4519)..(4519): n is a, c, g, or t
cggattgtcagactgctcctccctcttctttagactgccacgaggaaaaagcagatgtgagaactcaaggttcagggctgctcttctaagaaacaagtctgccataatctccatctgtgttggaatctgttaactaatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaaacatgccagtgacagccacacctgtgtgaagacaaaacacaatgagatcatggccatattctttaccagtggaacaagtggatatccgaaaatgactgcacacacccacagcagttttggtttaggattatctgtaaatggaaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaaacactctccaagtaccccatcacagtcttctgttcagcaccaactgtataccgaatgcttgtacagaatgatataaccagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaagattgtagatgtaaatggcaatgttctacctcctggacaagaaggagatattggcattcaagttctacccaaccgaccatttggcctttttactcattacgtaggtagtaaaggcttttgtcgttctaaatcctgattacaagtcacatgatcaagaacaactaataaaggagattcaggagcatgttaaaaaaactacagcaccttacaaatatcccagaaaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctccacattagtgtcaatgttcctatcatttcttaatataaaaataataccatcaattgctgattaatttttaaatgtatagtatagaagcagtttctgaaccagatctctgctacataggttttcaaactttagttgactaattcttctgatatgttgatatacaaatcagaaccaatgttcaagcctgaaataaaactaaagaacttataaaagtttttagaaaaatataaaatatcagttagaagattatgataatctcaaagtacaagaatctacctgaaaatagactagggatttttattagtcacattttttgcaaataatttaaaaatagtttagacttgtttcaaggtctaactataaaagaaggatcatatactattgttgcttattatatgtaatctaataaatactgtttacaaaagattacacttgtggttcctgaagaaagtatggtaaatgcagtaaacattaatatataaaataaaaataaaatagtgtaagatgttatcagaatactcatgtttggaaattcaaggaacaattaggattcatacatgaaaggttatcaattcctcattgaaggcctgagtctcaaagaatttttggtggaaatacttaaatttctgtcacaaatatggcttgtttctggagaactaaaagtgagtccccctgtggaatgagatggaaccatgctgttggctctttccttttgaagtgtttgttcccatttgaaataaccacaacattttctgttttcttggtatttcccgatagggcaacaatagaagacttttccatggttcggtccattattagaaacaacaagtctcttagatctccgaccacacttgcataatggaggtgtcattttcccactcttccatggctcttgtaggttaactgtagaagttaatatagatgggagacgcctccaggaagaacttcttactggggagcaatcagatgatgtaggcttttcttcatgaatagtgaagggttgtttttttgctggtgggaaagcttggggactgcatggattccttttggtaccacctgaaagaagaggatgtttccccaaaactaaaggatgagacatattggcattaactctgttgaaggtacttgatttgtgttcaggtaacttaaaggcagaaatatctgaacctggatctttggcttcttttacattataaatagtagtgtgaggactcttgtacacaatagacttagaagtctcagatttttgaggagtttcctctatgtctccaaagttttcatgacttgacatttccaattctttcaaaaccattaatctttctccagaattaaatgaaatctctaagtctgagtcactaatgggaactgtacagtctacgttttcctcaggctgagatgctggcagtaaaaccacatcctcccaatcagccaacacaggtaaacagtccagagtagagctcatttccaaatcagaaacatgatgaacagttggaacggtggtagaaacaagtaccaattctgaaccaactgttgaagccttagatttggtattaaatgcaagatgttcattttttccttgcttttgcatanagataggtgaattcaaggtaggagactgcaactgccccacagaagtagaggacttagtattaaaaagaggtaaggaacttttgacattgtgaagacttgcttttatattgttttttacttgtaattgatcctgttgtgcctttataggagaatttgcacaaattgacttcatttgaactttttcatgaggatttattatatttttaggctccttattatatatgctgggaccctggatgctaatgttacaggcagacatttcttcaacttgaattgtattcaaatttctggccagaatgctgaaattcttcttagtgggaacctatgattccacagacaaatgcaacagctttagaaactgtgcattcgttaatttcttcagtatacagttttatgacaaaaaagagaaatgtcattgatttataaatgactgcacacattaaatctacgtttcaaagaacgtatgactgtttatgaagtttgagatgacagaataaaaaggcaagacactactaaccttgttcaacgaccttgtaattttcattacacaaccatctctgatcattttccaagcaagaagggcagtattccgagaatcgtccaaccctgaggatacagatatcaaacactgaatttagtggtactagtactatttccttagtnctaaagaaataacttaaaaagaaaaacaccacttgtgtagaaattggaacacagttttagttttatgaccatctactaattttaatcatgataaactggtcttggaagtggaaggctatggcagcattaccagtgaaagacaagctcgtccacatttatagaggaggatatgaaaatgtattagacagttccccaaaatgtggccagcgttctgcaggaaccaggatttgtgaataatctaatagtcttgttcagttttttcactagtccattctattatttgagcacttgtttaatctccatttgatttggctcattcttttcattcttcttagcaactagaaagccactagatggcagtntatcttacaatagtttatgaaagtggtaatttgaaagtcttagaaacaatgtgaattgtttagattaggagttttttttttttaggctgaagatatcccttactaatgacattaccaaaaaatgaaattcatatgaagtattttttaaaagtcaaatggcttacataatttttaatgtatactaaccagaatgttctcgtcctgagaattctattcctacttcctgcaaggcaccacttagtccttttggttttctcctatagaaaagctaaccaataaaaaaagatatatttaaaagaagattactattttaaagactatgtattaaacacttttcataatttttagttctattagatttagaatgtgcttattttttgtgtgttgtttttaaatactttaagaaatgcatttatgtg

SEQ ID NO: 359682 - DNA, 447 bp, Homo sapiens
cattcatgagggatccatgtctatgatgcaaacacctcccaccaaaccccacatccaacaagggaatcacattttaacatgagatttggaggggatgaaacatctaaaccatatcacctggcaattttcattgtgtacaaagatttgtagaggcattgagtggtttttcccttgcctctgtgtaggtctgagctggcatggggctgacctgcagtcttgcagaggctccactggactctggttcccctgcctttctgcatcgttccccagaggtcccaactgagggcctggaatgtgtcaacaccaaaaaatggctgaaaatacagcccttcttttttaagccatttttacaattgttttttaacctcttatgttgtacaacttagtcagtaaatgtgtcgaggagataaccagtattggttggctttcttctctgacattcatatt

SEQ ID NO: 359683 - DNA, 2705 bp, Homo sapiens
  misc_feature (639)..(639): n is a, c, g, or t
accaattaaggaaaaaaataacccacaaaagaatggctgggaattatctctcatggcctttattttcttcatattagatctccagaaatctatttgaattaattttgttatcatttgctaaatcactggaggccatgtctacactgccaagagaaaaaagttcaaaaactcatttcaaacagcttcctaccaaaccagtcggggatattctatacagtataccaatataaaaaatacagaagaattatttgttctgatcctattccaaattatataagttgataaccaaatgttaccattggaaaacgtcttggaactatttaagtctttctattgcactttttcttccaactttaaaagacaaaattttaaaatctgaccccagcccttgtgattgttcagtatataatcaatggtatcttacaaggactattttatttggaatcaatcaaatttgtttcctgccaacaataagttagattgttttttgcagttctcaagtaacaaatatgaggaccgaactctcattcaacatccaagcccttgcagtttgtgcaaatatatgtttagcaacaaaggacagacagaatccatcattagtatggctttttactggaatgttttgcatttattcattgntctttgcttggagagcaaatttagatatttcaaaaccacttttcatgggtgtggtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacagatgatgacttacgagtggtatttacccaagatggcaaagcacttgccaggtgtcaactttcctgggaaccggtggaatcctgtggaaggaatattacctagtggaatggtcacatttaatctttatcattttcttgaagtaaataaacaaaaagaaacatttgtttgcataggaattcatgaaggcgacccaacctggaaaaagaactattcactttggccatgggggtcttgtgacaaattagttcctttggagattgtattcaaccctgaggaatggattaaacttacaaaaagtatctataactggaccgaagaatatggaaggtttgatccatcttcttgggaatctgtggccaatgaagaaatgtggcaagcgaggatgaaaacaccgttcttcatctttaacctggcagaaactgctcacatgccttcaaaagtgaaagctcaactctacgctcaagcatatgacctttataaggagattgtctatttacaaaaggagcacccagtgaattggcacaagaactatgccatcgcctgtgagcggatgctgcgtcttcaggcaagagatgcagatcctgaagtgctgttatcggaaaccatcagacatttccgtctgtactctcagaaagcaccgaatgacccacagcaagctgatattttaggtgctctaaagcacctaagaaaagaactgcaaagtctgagaaataggaaaaatgtctgagacagcaaaatatgaaaaacctgctcatcgttcagcttccaaaattctgaagtctggaagtttttccttcaagaaaagaaactgcataaaaaatttaaaactaagtcatctcccagatataagtatcatggtccagcagtactgtttaatggggtattcagtgactaaggtctgctatttatgcaaaattctgtttatcccgtgttaccaaattaccatttcagtgagaagcttttgaaaagtcttctgacttccagtctttcaccagatgactgcactggattagattctagaagagaatgaaccattttcatataactaaatattggtcatgaactgtgtaagggccatgcttattgggatcagttttaaagttaaattcttttgatattaataccagaccaaagacattttctgtttcctggaaaaaaaaaatgaatcatgttaggctttaggtgagagtacattttttacaaagtagctatagttgttacatagtcttacacttcaagctaaacaccaaatgggtgatattttgaaaaaagtttgtgttttactgtcttagatcgttcttggaaatcactaaaaaaaaaaaaagttaatttgatgtttgcttatttcagttgcagaaactggcgagtaaaaaagattttgcatttacttaattaattttatatttatgttttatttctatttggactcagagatctagacccaataattagtaggctcctgctgccaaaatgcaaaggggaaaaaaaggcagggattgggggggatggggaagtggcccaataaattcatttctgttacaagcatcttttatacatattactaaagagaacatagtaagaaatgcaaataatagttctttattttattatgacagttaattaatagcaacctgttttaatgaataaagtcactcagagtccttcagcacttcctaagtagaggccagaatctgtagggcttcttttccccccaattgtatagctcctagactccaagcactatataggcccctgtatagaaatgctcactaatgaagagggagggctagaagcttgtctgcattcaaagatcactggtgagtcattcagcaagaaaaggcccc

SEQ ID NO: 359684 - DNA, 1575 bp, Homo sapiens
tataaaagaacaaactggatgtggaaaggctacttgtccaagggcacactgctgctagtgatggagtccaaagttcacatctgtctgcctctggaacactcatctaactaaagatgaaaacaccgttcttcatctttaacctggcagaaactgctcacatgccttcaaaagtgaaagctcaactctacgctcaagcatatgacctttataaggagattgtctatttacaaaaggagcacccagtgaattggcacaagaactatgccatcgcctgtgagcggatgctgcgtcttcaggcaagagatgcagatcctgaagtgctgttatcggaaaccatcagacatttccgtctgtactctcagaaagcaccgaatgacccacagcaagctgatattttaggtgctctaaagcacctaagaaaagaactgcaaagtctgagaaataggaaaaatgtctgagacagcaaaatatgaaaaacctgctcatcgttcagcttccaaaattctgaagtctggaagtttttccttcaagaaaagaaactgcataaaaaatttaaaactaagtcatctcccagatataagtatcatggtccagcagtactgtttaatggggtattcagtgactaaggtctgctatttatgcaaaattctgtttatcccgtgttaccaaattaccatttcagtgagaagcttttgaaaagtcttctgacttccagtctttcaccagatgactgcactggattagattctagaagagaatgaaccattttcatataactaaatattggtcatgaactgtgtaagggccatgcttattgggatcagttttaaagttaaattcttttgatattaataccagaccaaagacattttctgtttcctggaaaaaaaaaatgaatcatgttaggctttaggtgagagtacattttttacaaagtagctatagttgttacatagtcttacacttcaagctaaacaccaaatgggtgatattttgaaaaaagtttgtgttttactgtcttagatcgttcttggaaatcactaaaaaaaaaaaaagttaatttgatgtttgcttatttcagttgcagaaactggcgagtaaaaaagattttgcatttacttaattaattttatatttatgttttatttctatttggactcagagatctagacccaataattagtaggctcctgctgccaaaatgcaaaggggaaaaaaaggcagggattgggggggatggggaagtggcccaataaattcatttctgttacaagcatcttttatacatattactaaagagaacatagtaagaaatgcaaataatagttctttattttattatgacagttaattaatagcaacctgttttaatgaataaagtcactcagagtccttcagcacttcctaagtagaggccagaatctgtagggcttcttttccccccaattgtatagctcctagactccaagcactatataggcccctgtatagaaatgctcactaatgaagagggagggctagaagcttgtctgcattcaaagatcactggtgagtcattcagcaagaaaaggcccc

SEQ ID NO: 359685 - DNA, 1749 bp, Homo sapiens
ttctccaacagctaaatttagagtttcaacccttctgcctgttgagtaaatagctttccatgaattaaaactaaatcccttccccagaacatctttctggaggaagagcattttgtcctaacactgtgtcttcggtttcccctgcaacatctaaaaacctcagaagcagttttagaagcagcatatttgcctcctgctactgtaataattgcagtaacattcttgggttctctgcatggcttagcaatgattagatttttactggaggctgcttgaatttttttttcttgttattaattcctctgtgtttttttgtttttgaaaaaaaaaaagtcaaagaataacaatggaataccaacatttctgctgttttctagctttataaggagattgtctatttacaaaaggagcacccagtgaattggcacaagaactatgccatcgcctgtgagcggatgctgcgtcttcaggcaagagatgcagatcctgaagtgctgttatcggaaaccatcagacatttccgtctgtactctcagaaagcaccgaatgacccacagcaagctgatattttaggtgctctaaagcacctaagaaaagaactgcaaagtctgagaaataggaaaaatgtctgagacagcaaaatatgaaaaacctgctcatcgttcagcttccaaaattctgaagtctggaagtttttccttcaagaaaagaaactgcataaaaaatttaaaactaagtcatctcccagatataagtatcatggtccagcagtactgtttaatggggtattcagtgactaaggtctgctatttatgcaaaattctgtttatcccgtgttaccaaattaccatttcagtgagaagcttttgaaaagtcttctgacttccagtctttcaccagatgactgcactggattagattctagaagagaatgaaccattttcatataactaaatattggtcatgaactgtgtaagggccatgcttattgggatcagttttaaagttaaattcttttgatattaataccagaccaaagacattttctgtttcctggaaaaaaaaaatgaatcatgttaggctttaggtgagagtacattttttacaaagtagctatagttgttacatagtcttacacttcaagctaaacaccaaatgggtgatattttgaaaaaagtttgtgttttactgtcttagatcgttcttggaaatcactaaaaaaaaaaaaagttaatttgatgtttgcttatttcagttgcagaaactggcgagtaaaaaagattttgcatttacttaattaattttatatttatgttttatttctatttggactcagagatctagacccaataattagtaggctcctgctgccaaaatgcaaaggggaaaaaaaggcagggattgggggggatggggaagtggcccaataaattcatttctgttacaagcatcttttatacatattactaaagagaacatagtaagaaatgcaaataatagttctttattttattatgacagttaattaatagcaacctgttttaatgaataaagtcactcagagtccttcagcacttcctaagtagaggccagaatctgtagggcttcttttccccccaattgtatagctcctagactccaagcactatataggcccctgtatagaaatgctcactaatgaagagggagggctagaagcttgtctgcattcaaagatcactggtgagtcattcagcaagaaaaggcccc

SEQ ID NO: 359686 - DNA, 508 bp, Homo sapiens
atgaaggttcctatccccacccccaggatgaaaacaccgttcttcatctttaacctggcagaaactgctcacatgccttcaaaagtgaaagctcaactctacgctcaagcatatgacgtatgttacacttttatatgtagatatagatatatttggtgggaaggtgatggtgattgttcagaatggatagagggtatatcacattagaatttttattattttatttctctcaatttgggtggtataaagcagcacatatgaacaaatcctcagttgtatcacagtatccaaagtaaatggctgtggtaggcagaataatacctcccacccaaaaaagatgtctagtcctaatctccacaacctgtgaatatgttacctatgtaacaaagcagggggtggtggggattaagttaggtgtcttgagacagggggttaccccagattatccaggtgggcccaacataatcataaaggtcctcatgaaagggaagcaggcaggtcagagtca

SEQ ID NO: 359687 - DNA, 3243 bp, Homo sapiens
gacccggaagccgccgtggccgccgcacaagctgcgctcgtctctcggctggggagctccgtgtcgcaccgggttcttgggctggccgtgtccttctccctcggtcgccactggcccatgagtccccatggcgacggcaggggccaggcccaggggcgggcagtccgagtggggctgcggcgctccgggggcatccgcggcggcgtggcggtgttcgccgccgtggccgcagtgttcaccttcaccctgcccccttcggtaccggggggagactccggggaactgatcacagccgcacatgagcttggagttgcccatcctcctggctatcctttgttcactctggtggctaaactggcaattacactgtttccttttggttcaattgcctaccgcgtcaatcttctctgtggcttatttggagcagtagctgcatcattactttttttcaccgttttcaggctttctggctcatctgctggaggaatccttgctgcgggggtgttttcattttctcgtctaacatggcagtggtccattgcagcagaggtttttagcttaaacaatctctttgtggggctgcttatggctcttactgtacattttgaggaagcagcaactgctaaggagagatcaaaggtagctaaaattggtgctttctgctgtggccttagtttatgtaaccagcacacaataatactctatgttttgtgcataataccttggattctctttcaacttttaaaaaagaaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaagtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacagtgtttgtgaccaaaggaccaactatgtgattgataagttcgcaaagaaccttctcacctctatgcctcatgatgcaattatcttactcagaggagatttgccaggaaattctctccgttacatgcattactgtgaggggttgaggcctgacatttcattagtggatcaggaaatgatgacttacgagtggtatttacccaagatggcaaagcacttgccaggtgtcaactttcctgggaaccggtggaatcctgtggaaggaatattacctagtggaatggtcacatttaatctttatcattttcttgaagtaaataaacaaaaagaaacatttgtttgcataggaattcatgaaggcgacccaacctggaaaaagaactattcactttggccatgggggtcttgtgacaaattagttcctttggagattgtattcaaccctgaggaatggattaaacttacaaaaagtatctataactggaccgaagaatatggaaggtttgatccatcttcttgggaatctgtggccaatgaagaaatgtggcaagcgaggatgaaaacaccgttcttcatctttaacctggcagaaactgctcacatgccttcaaaagtgaaagctcaactctacgctcaagcatatgacctttataaggagattgtctatttacaaaaggagcacccagtgaattggcacaagaactatgccatcgcctgtgagcggatgctgcgtcttcaggcaagagatgcagatcctgaagtgctgttatcggaaaccatcagacatttccgtctgtactctcagaaagcaccgaatgacccacagcaagctgatattttaggtgctctaaagcacctaagaaaagaactgcaaagtctgagaaataggaaaaatgtctgagacagcaaaatatgaaaaacctgctcatcgttcagcttccaaaattctgaagtctggaagtttttccttcaagaaaagaaactgcataaaaaatttaaaactaagtcatctcccagatataagtatcatggtccagcagtactgtttaatggggtattcagtgactaaggtctgctatttatgcaaaattctgtttatcccgtgttaccaaattaccatttcagtgagaagcttttgaaaagtcttctgacttccagtctttcaccagatgactgcactggattagattctagaagagaatgaaccattttcatataactaaatattggtcatgaactgtgtaagggccatgcttattgggatcagttttaaagttaaattcttttgatattaataccagaccaaagacattttctgtttcctggaaaaaaaaaatgaatcatgttaggctttaggtgagagtacattttttacaaagtagctatagttgttacatagtcttacacttcaagctaaacaccaaatgggtgatattttgaaaaaagtttgtgttttactgtcttagatcgttcttggaaatcactaaaaaaaaaaaaagttaatttgatgtttgcttatttcagttgcagaaactggcgagtaaaaaagattttgcatttacttaattaattttatatttatgttttatttctatttggactcagagatctagacccaataattagtaggctcctgctgccaaaatgcaaaggggaaaaaaaggcagggattgggggggatggggaagtggcccaataaattcatttctgttacaagcatcttttatacatattactaaagagaacatagtaagaaatgcaaataatagttctttattttattatgacagttaattaatagcaacctgttttaatgaataaagtcactcagagtccttcagcacttcctaagtagaggccagaatctgtagggcttcttttccccccaattgtatagctcctagactccaagcactatataggcccctgtatagaaatgctcactaatgaagagggagggctagaagcttgtctgcattcaaagatcactggtgagtcattcagcaagaaaaggcccc

SEQ ID NO: 359688 - DNA, 3358 bp, Homo sapiens
  misc_feature (1120)..(1120): n is a, c, g, or t
gacccggaagccgccgtggccgccgcacaagctgcgctcgtctctcggctggggagctccgtgtcgcaccgggttcttgggctggccgtgtccttctccctcggtcgccactggcccatgagtccccatggcgacggcaggggccaggcccaggggcgggcagtccgagtggggctgcggcgctccgggggcatccgcggcggcgtggcggtgttcgccgccgtggccgcagtgttcaccttcaccctgcccccttcggtaccggggggagactccggggaactgatcacagccgcacatgagcttggagttgcccatcctcctggctatcctttgttcactctggtggctaaactggcaattacactgtttccttttggttcaattgcctaccgcgtcaatcttctctgtggcttatttggagcagtagctgcatcattactttttttcaccgttttcaggctttctggctcatctgctggaggaatccttgctgcgggggtgttttcattttctcgtctaacatggcagtggtccattgcagcagaggtttttagcttaaacaatctctttgtggggctgcttatggctcttactgtacattttgaggaagcagcaactgctaaggagagatcaaaggtagctaaaattggtgctttctgctgtggccttagtttatgtaaccagcacacaataatactctatgttttgtgcataataccttggattctctttcaacttttaaaaaagaaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaaggacagacagaatccatcattagtatggctttttactggaatgttttgcatttattcattgntctttgcttggagagcaaatttagatatttcaaaaccacttttcatgggtgtggtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacagtgtttgtgaccaaaggaccaactatgtgattgataagttcgcaaagaaccttctcacctctatgcctcatgatgcaattatcttactcagaggagatttgccaggaaattctctccgttacatgcattactgtgaggggttgaggcctgacatttcattagtggatcaggaaatgatgacttacgagtggtatttacccaagatggcaaagcacttgccaggtgtcaactttcctgggaaccggtggaatcctgtggaaggaatattacctagtggaatggtcacatttaatctttatcattttcttgaagtaaataaacaaaaagaaacatttgtttgcataggaattcatgaaggcgacccaacctggaaaaagaactattcactttggccatgggggtcttgtgacaaattagttcctttggagattgtattcaaccctgaggaatggattaaacttacaaaaagtatctataactggaccgaagaatatggaaggtttgatccatcttcttgggaatctgtggccaatgaagaaatgtggcaagcgaggatgaaaacaccgttcttcatctttaacctggcagaaactgctcacatgccttcaaaagtgaaagctcaactctacgctcaagcatatgacctttataaggagattgtctatttacaaaaggagcacccagtgaattggcacaagaactatgccatcgcctgtgagcggatgctgcgtcttcaggcaagagatgcagatcctgaagtgctgttatcggaaaccatcagacatttccgtctgtactctcagaaagcaccgaatgacccacagcaagctgatattttaggtgctctaaagcacctaagaaaagaactgcaaagtctgagaaataggaaaaatgtctgagacagcaaaatatgaaaaacctgctcatcgttcagcttccaaaattctgaagtctggaagtttttccttcaagaaaagaaactgcataaaaaatttaaaactaagtcatctcccagatataagtatcatggtccagcagtactgtttaatggggtattcagtgactaaggtctgctatttatgcaaaattctgtttatcccgtgttaccaaattaccatttcagtgagaagcttttgaaaagtcttctgacttccagtctttcaccagatgactgcactggattagattctagaagagaatgaaccattttcatataactaaatattggtcatgaactgtgtaagggccatgcttattgggatcagttttaaagttaaattcttttgatattaataccagaccaaagacattttctgtttcctggaaaaaaaaaatgaatcatgttaggctttaggtgagagtacattttttacaaagtagctatagttgttacatagtcttacacttcaagctaaacaccaaatgggtgatattttgaaaaaagtttgtgttttactgtcttagatcgttcttggaaatcactaaaaaaaaaaaaagttaatttgatgtttgcttatttcagttgcagaaactggcgagtaaaaaagattttgcatttacttaattaattttatatttatgttttatttctatttggactcagagatctagacccaataattagtaggctcctgctgccaaaatgcaaaggggaaaaaaaggcagggattgggggggatggggaagtggcccaataaattcatttctgttacaagcatcttttatacatattactaaagagaacatagtaagaaatgcaaataatagttctttattttattatgacagttaattaatagcaacctgttttaatgaataaagtcactcagagtccttcagcacttcctaagtagaggccagaatctgtagggcttcttttccccccaattgtatagctcctagactccaagcactatataggcccctgtatagaaatgctcactaatgaagagggagggctagaagcttgtctgcattcaaagatcactggtgagtcattcagcaagaaaaggcccc

SEQ ID NO: 359689 - DNA, 1800 bp, Homo sapiens
gacccggaagccgccgtggccgccgcacaagctgcgctcgtctctcggctggggagctccgtgtcgcaccgggttcttgggctggccgtgtccttctccctcggtcgccactggcccatgagtccccatggcgacggcaggggccaggcccaggggcgggcagtccgagtggggctgcggcgctccgggggcatccgcggcggcgtggcggtgttcgccgccgtggccgcagtgttcaccttcaccctgcccccttcggtaccggggggagactccggggaactgatcacagccgcacatgagcttggagttgcccatcctcctggctatcctttgttcactctggtggctaaactggcaattacactgtttccttttggttcaattgcctaccgcgtcaatcttctctgtggcttatttggagcagtagctgcatcattactttttttcaccgttttcaggctttctggctcatctgctggaggaatccttgctgcgggggtgttttcattttctcgtctaacatggcagtggtccattgcagcagaggtttttagcttaaacaatctctttgtggggctgcttatggctcttactgtacattttgaggaagcagcaactgctaaggagagatcaaaggtagctaaaattggtgctttctgctgtggccttagtttatgtaaccagcacacaataatactctatgttttgtgcataataccttggattctctttcaacttttaaaaaagaaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaagtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacaggtaatacatggttatttttatgaaaagtagctgtcaagccagagatacctgaatatttagattctaacactttatttcattgttaacttctggttttcaagactcaaagtgagacagcttggttgaatgcagtagttctttaacttttagggtcgttaaacctaaaagttaaagcatgggcgatgaatggtttcaggccattgcaaacaagggtttaggtggtgcgtgtagacaatttgtatctttttctcttaagaacccaagagatacttttagaatccctagtataggtaaaattccatgacctaaaataccacttagatggagagtaaaatgatttagagttttttgtataccctaaaataattcactttatgcttccctttatgtccagtttactctgtagtagtaaatactaatttttttgagacaaggtcttattctgtcccctaggctggagtacagtggcatgatcgtagcttactacagccgtgaaattctgggctcaagcagtcctctgcctcagcctcctcagtagctaggactatggacacatgccaccattagcatgc

SEQ ID NO: 359690 - DNA, 4049 bp, Homo sapiens
ggcgtctgggaagtgaggagcgtctctgcctggcagaggctgcaatctctgcactttggggggccaaggcaggcgctgagaaggacgcgcagtccatctctctcagggttagtgaaatgaggctctccgcccgggccggcccggggacagtgcgctgctggtcccagcatgaatgcgggccccggctgtgaaccctgcaccaagcgaccccgctggggcgccgctacaacttcgccggctgcttcggacgcccggagctttcccagcaggcagaggcgcgtcctcgaccccaaggacgctcacgtgcagttcagggtcccaccgtcctcgccagcctgcgtcccagggcaggcgggacagcacagaggcagcgccacctcgcttgttttcaaacaaaagactattaccagttggatggacactaaaggaatcaagacagcggaatcagaaagtttggatagtaaagaaaacaacaatacaagaatagaatccatgatgagttctgtacaaaaagataacttttaccaacataatgtagaaaaattagaaaatgtttctcagctaagtcttgataagtcactcactgaaaaaagtacacagtatttgaaccagcatcagactgcagcaatgtgtaagtggcaaaatgaagggaaacacacggagcagcttttggaaagtgaacctcaaacagtaaccctggtaccagagcagtttagtaatgctaacattgatcggtcacctcaaaatgatgatcacagtgacacagatagtgaagagaatagagacaatcaacagtttctcacaactgtaaagcttgcaaatgcaaagcagactacggaagatgaacacgccagagaagccaaaagccaccagaagtgcagcaagtcttgccatcctggggaagactgtgcaagttgtcagcaagatgagatagacgtggtgccaaagagtccattgtcagatgttggctctgaggatgttggtactgggtcaaaaaatgacaacaaattgattagacaagaaagttgcctaggaaattctcctccatttgagaaggaaagtgaacccgaatcaccgatggatgtggataattctaaaaatagttgtcaagactcagaagcagatgaggagacaagtccaggttttgatgaacaagaagatggtagttcctcccaaacagcaaataaaccttcaaggttccaagcaagagacgctgacattgaatttaggaaacggtactctactaagggcggtgaagttagattacatttccaatttgaaggaggagagagtcgcactggaatgaatgatttaaatgctaaactacctggaaatatttctagcctgaatgtagaatgcagaaattctaagcaacatggaaaaaaggattctaaaatcacagatcatttgatgagactgcccaaagcagaggacagaagaaaagaacagtgggaaaccaaacatcaaagaacagaaaggaagatccctaaatacgttccacctcacctttctccagataagaagtggcttggaactcccattgaggagatgagaagaatgcctcggtgtgggatccggctgcctctcttgagaccatctgccaatcacacagtaactattcgggtagatcttttgcgagcaggagaagttcctaaaccttttccaacacattataaagatttgtgggataacaagcatgttaaaatgccttgttcagaacaaaatttgtacccagtggaagatgagaatggtgagcgaactgcggggagccggtgggagctcattcagactgcacttctcaacaaatttacacgaccccaaaacttgaaggatgctattctgaaatacaatgtggcatattctaagaaatgggactttacagctttgatcgatttctgggataaggtacttgaagaagcagaagctcaacatttatatcagtccatcttgcctgatatggtgaaaattgcactctgtctgccaaatatttgcacccagccaataccactcctgaaacagaagatgaatcattccatcacaatgtcgcaggaacagattgccagtcttttagctaatgctttcttctgcacatttccacgacgaaatgctaagatgaaatcggagtattctagttacccagacattaacttcaatcgattgtttgagggacgttcatcaaggaaaccggagaaacttaaaacgctcttctgctactttagaagagtcacagagaaaaaacctactgggttggtgacatttacaagacagagtcttgaagattttccagaatgggaaagatgtgaaaaacccttgacacgattgcatgtcacttacgaaggtaccatagaagaaaatggccaaggcatgctacaggtggattttgcaaatcgttttgttggaggtggtgtaaccagtgcaggacttgtgcaagaagaaatccgctttttaatcaatcctgagttgattatttcacggctcttcactgaggtgctggatcacaatgaatgtctaattatcacaggtactgagcagtacagtgaatacacaggctatgctgagacatatcgttggtcccggagccacgaagatgggagtgaaagggacgactggcagcggcgctgcactgagatcgttgccatcgatgctcttcacttcagacgctacctcgatcagtttgtgcctgagaaaatgagacgcgagctgaacaaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcatttttatctgtaatggtttgtctgtcttttttcctctgatcagtatttttttataccagttttggagactggctgagatgaaaggaaatgtggaataaaaggaggttttcctgatgtggtgtaaagaaaacagattcaagagaattgaagattttttttgtttcttggtacttttttctttttaaattaggactaatgtttcttttgtggtgcttgaggcatattcatataaccaaagtttgagaactgggaacttcatgctgatttgtacatattgaagtttctctggtattcaaaggttatatagtgaatgaattttcattaataaatcactttgtcag

SEQ ID NO: 359691 - DNA, 998 bp, Homo sapiens
cggttcccgttaagcgccacacttccgctttgcggcaatgtgcgccccggaagctggaagcgcctgacggcagctttccggtggtgggaaagtgaacgaatcccgaatcaaagcggcgcattgaggcaggtggggtgccagtggaagagggaaggcaggcgagtgtttacggcctgacttgggaggccggcggatcagcaattgcagaagcaggcagcggcagagagggaatggtgcaggcaggcgctgagaaggacgcgcagtccatctctctcagggttagtgaaatgaggctctccgcccgggccggcccggggacagtgcgctgctggtcccagcatgaatgcgggccccggctgtgaaccctgcaccaagcgaccccgctggggcgccgctacaacttcgccggctgcttcggacgcccggagctttcccagcaggcagaggcgcgtcctcgaccccaaggacgctcacgtgcagttcagggtcccaccgtcctcgccagcctgcgtcccagggcaggcgggacagcacagaggcagcgccacctcgcttggtacgtgggaaaataaaaatctttgtccttcgcctcggcccgaaccttctggtctcagggactccagtcactcctttctggtcttgtgtgcatcatcactctgaggtccacttgctgagctaccaaagccactagtgggtgaatggggccgcatttttcccagtgcgattgatgtgagaaactctgatgagcagtcactcacagggcggaaaatggcaggagactccaccacctgtttgcttcttcaggtttgattgagaaattgccttagtcgtcaaggagatctaattgtgtatgtaaaacagtagggcgcttcagcctctagataggaagaaaacaacttcacttgtgcagattctgggtcccagggtgcagagctattagtctaagctggcattgtacccgtccctggtatacagtgttgaatgagagaaacttggcc

SEQ ID NO: 359692 - DNA, 746 bp, Homo sapiens
cggttcccgttaagcgccacacttccgctttgcggcaatgtgcgccccggaagctggaagcgcctgacggcagctttccggtggtgggaaagtgaacgaatcccgaatcaaacctgcaccaagcgaccccgctggggcgccgctacaacttcgccggctgcttcggacgcccggagctttcccagcaggcagaggcgcgtcctcgaccccaaggacgctcacgtgcagttcagggtcccaccgtcctcgccagcctgcgtcccagggcaggcgggacagcacagaggcagcgccacctcgcttggtacgtgggaaaataaaaatctttgtccttcgcctcggcccgaaccttctggtctcagggactccagtcactcctttctggtcttgtgtgcatcatcactctgaggtccacttgctgagctaccaaagccactagtgggtgaatggggccgcatttttcccagtgcgattgatgtgagaaactctgatgagcagtcactcacagggcggaaaatggcaggagactccaccacctgtttgcttcttcaggtttgattgagaaattgccttagtcgtcaaggagatctaattgtgtatgtaaaacagtagggcgcttcagcctctagataggaagaaaacaacttcacttgtgcagattctgggtcccagggtgcagagctattagtctaagctggcattgtacccgtccctggtatacagtgttgaatgagagaaacttggcc

SEQ ID NO: 359693 - DNA, 4254 bp, Homo sapiens
cggttcccgttaagcgccacacttccgctttgcggcaatgtgcgccccggaagctggaagcgcctgacggcagctttccggtggtgggaaagtgaacgaatcccgaatcaaagcggcgcattgaggcaggtggggtgccagtggaagagggaaggcagttttcaaacaaaagactattaccagttggatggacactaaaggaatcaagacagcggaatcagaaagtttggatagtaaagaaaacaacaatacaagaatagaatccatgatgagttctgtacaaaaagataacttttaccaacataatgtagaaaaattagaaaatgtttctcagctaagtcttgataagtcactcactgaaaaaagtacacagtatttgaaccagcatcagactgcagcaatgtgtaagtggcaaaatgaagggaaacacacggagcagcttttggaaagtgaacctcaaacagtaaccctggtaccagagcagtttagtaatgctaacattgatcggtcacctcaaaatgatgatcacagtgacacagatagtgaagagaatagagacaatcaacagtttctcacaactgtaaagcttgcaaatgcaaagcagactacggaagatgaacacgccagagaagccaaaagccaccagaagtgcagcaagtcttgccatcctggggaagactgtgcaagttgtcagcaagatgagatagacgtggtgccaaagagtccattgtcagatgttggctctgaggatgttggtactgggtcaaaaaatgacaacaaattgattagacaagaaagttgcctaggaaattctcctccatttgagaaggaaagtgaacccgaatcaccgatggatgtggataattctaaaaatagttgtcaagactcagaagcagatgaggagacaagtccaggttttgatgaacaagaagatggtagttcctcccaaacagcaaataaaccttcaaggttccaagcaagagacgctgacattgaatttaggaaacggtactctactaagggcggtgaagttagattacatttccaatttgaaggaggagagagtcgcactggaatgaatgatttaaatgctaaactacctggaaatatttctagcctgaatgtagaatgcagaaattctaagcaacatggaaaaaaggattctaaaatcacagatcatttgatgagactgcccaaagcagaggacagaagaaaagaacagtgggaaaccaaacatcaaagaacagaaaggaagatccctaaatacgttccacctcacctttctccagataagaagtggcttggaactcccattgaggagatgagaagaatgcctcggtgtgggatccggctgcctctcttgagaccatctgccaatcacacagtaactattcgggtagatcttttgcgagcaggagaagttcctaaaccttttccaacacattataaagatttgtgggataacaagcatgttaaaatgccttgttcagaacaaaatttgtacccagtggaagatgagaatggtgagcgaactgcggggagccggtgggagctcattcagactgcacttctcaacaaatttacacgaccccaaaacttgaaggatgctattctgaaatacaatgtggcatattctaagaaatgggactttacagctttgatcgatttctgggataaggtacttgaagaagcagaagctcaacatttatatcagtccatcttgcctgatatggtgaaaattgcactctgtctgccaaatatttgcacccagccaataccactcctgaaacagaagatgaatcattccatcacaatgtcgcaggaacagattgccagtcttttagctaatgctttcttctgcacatttccacgacgaaatgctaagatgaaatcggagtattctagttacccagacattaacttcaatcgattgtttgagggacgttcatcaaggaaaccggagaaacttaaaacgctcttctgctactttagaagagtcacagagaaaaaacctactgggttggtgacatttacaagacagagtcttgaagattttccagaatgggaaagatgtgaaaaacccttgacacgattgcatgtcacttacgaaggtaccatagaagaaaatggccaaggcatgctacaggtggattttgcaaatcgttttgttggaggtggtgtaaccagtgcaggacttgtgcaagaagaaatccgctttttaatcaatcctgagttgattatttcacggctcttcactgaggtgctggatcacaatgaatgtctaattatcacaggtactgagcagtacagtgaatacacaggctatgctgagacatatcgttggtcccggagccacgaagatgggagtgaaagggacgactggcagcggcgctgcactgagatcgttgccatcgatgctcttcacttcagacgctacctcgatcagtttgtgcctgagaaaatgagacgcgagctgaacaaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcatttttatctgtaatggtttgtctgtcttttttcctctgatcagtatttttttataccagttttggagactggctgagatgaaaggaaatgtggaataaaaggaggttttcctgatgtggtgtaaagaaaacagattcaagagaattgaagattttttttgtttcttggtacttttttctttttaaattaggactaatgtttcttttgtggtgcttgaggcatattcatataaccaaagtttgagaactgggaacttcatgctgatttgtacatattgaagtttctctggtattcaaaggttatatagtgaatgaattttcattaataaatcactttgtcagaaactcccatatcatctatattttatatatgtatatataaacgtatgctctttaagtgtgtctatatgtgagcacataaaatctaaataaaattggactggtgggaaacaaaaaaaaaaaaaaaaaaaaggggggggggggtaaaattcctgggggggcccactttatacggcgtcccccgtctttttttgtaacaaggggccccataaagggaggggccgtatataaaaacgccaggaggacgggcgcgtgttaaacaacgtctctctgctgggaaagaccgctgcgtggggattcttggggaagggccctacttgtgggcggcgaccattgtggggcagcctcccagcaaaataataaggctgagggaatataattactgtgtcatgtggaccaccctattgtgcgctgagttgtcccgatgttggattg

SEQ ID NO: 359694 - DNA, 3113 bp, Homo sapiens
ctcgtgccgaattcggcacgaggaatcggcggcgcattgaggcaggtggggtgccagtggaagagggaaggcaggcgagtgtttacggcctgacttgggaggccggcggatcagcaattgcagaagcaggcagcggcagagagggaatggtgcaggcaggcgctgagaaggacgcgcagtccatctctctcaggaaaagaacagtgggaaaccaaacatcaaagaacagaaaggaagatccctaaatacgttccacctcacctttctccagataagaagtggcttggaactcccattgaggagatgagaagaatgcctcggtgtgggatccggctgcctctcttgagaccatctgccaatcacacagtaactattcggaatggtgagcgaactgcggggagccggtgggagctcattcagactgcacttctcaacaaatttacacgaccccaaaacttgaaggatgctattctgaaatacaatgtggcatattctaagaaatgggactttacagctttgatcgatttctgggataaggtacttgaagaagcagaagctcaacatttatatcagtccatcttgcctgatatggtgaaaattgcactctgtctgccaaatatttgcacccagccaataccactcctgaaacagaagatgaatcattccatcacaatgtcgcaggaacagattgccagtcttttagctaatgctttcttctgcacatttccacgacgaaatgctaagatgaaatcggagtattctagttacccagacattaacttcaatcgattgtttgagggacgttcatcaaggaaaccggagaaacttaaaacgctcttctgctactttagaagagtcacagagaaaaaacctactgggttggtgacatttacaagacagagtcttgaagattttccagaatgggaaagatgtgaaaaacccttgacacgattgcatgtcacttacgaaggtaccatagaagaaaatggccaaggcatgctacaggtggattttgcaaatcgttttgttggaggtggtgtaaccagtgcaggacttgtgcaagaagaaatccgctttttaatcaatcctgagttgattatttcacggctcttcactgaggtgctggatcacaatgaatgtctaattatcacaggtactgagcagtacagtgaatacacaggctatgctgagacatatcgttggtcccggagccacgaagatgggagtgaaagggacgactggcagcggcgctgcactgagatcgttgccatcgatgctcttcacttcagacgctacctcgatcagtttgtgcctgagaaaatgagacgcgagctgaacaaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcatttttatctgtaatggtttgtctgtcttttttcctctgatcagtatttttttataccagttttggagactggctgagatgaaaggaaatgtggaataaaaggaggttttcctgatgtggtgtaaagaaaacagattcaagagaattgaagattttttttgtttcttggtacttttttctttttaaattaggactaatgtttcttttgtggtgcttgaggcatattcatataaccaaagtttgagaactgggaacttcatgctgatttgtacatattgaagtttctctggtattcaaaggttatatagtgaatgaattttcattaataaatcactttgtcagaaactcccatatcatctatattttatatatgtatatataaacgtatgctctttaagtgtgtctatatgtgagcacataaaatctaaataaaattggactggtgggaaacaaaaaaaaaaaaaaaaaaaaggggggggggggtaaaattcctgggggggcccactttatacggcgtcccccgtctttttttgtaacaaggggccccataaagggaggggccgtatataaaaacgccaggaggacgggcgcgtgttaaacaacgtctctctgctgggaaagaccgctgcgtggggattcttggggaagggccctacttgtgggcggcgaccattgtggggcagcctcccagcaaaataataaggctgagggaatataattactgtgtcatgtggaccaccctattgtgcgctgagttgtcccgatgttggattg

SEQ ID NO: 359695 - DNA, 2360 bp, Homo sapiens
agcaagcgccccgcgccgcgcaactccaagaccaactctgcctacgcacagcaccaggcagcggcagagagggaatggtgcaggcaggcgctgagaaggacgcgcagtccatctctctcagggttagtgaaatgaggctctccgcccgggccggcccggggacagtgcgctgctggtcccagcatgaatgcgggccccggctgtgaaccctgcaccaagcgaccccgctggggcgccgctacaacttcgccggctgcttcggacgcccggagctttcccagcaggcagaggcgcgtcctcgaccccaaggacgctcacgtgcagttcagggtcccaccgtcctcgccagcctgcgtcccagggcaggcgggacagcacagaggcagcgccacctcgcttggtactgagcagtacagtgaatacacaggctatgctgagacatatcgttggtcccggagccacgaagatgggagtgaaagggacgactggcagcggcgctgcactgagatcgttgccatcgatgctcttcacttcagacgctacctcgatcagtttgtgcctgagaaaatgagacgcgagctgaacaaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcatttttatctgtaatggtttgtctgtcttttttcctctgatcagtatttttttataccagttttggagactggctgagatgaaaggaaatgtggaataaaaggaggttttcctgatgtggtgtaaagaaaacagattcaagagaattgaagattttttttgtttcttggtacttttttctttttaaattaggactaatgtttcttttgtggtgcttgaggcatattcatataaccaaagtttgagaactgggaacttcatgctgatttgtacatattgaagtttctctggtattcaaaggttatatagtgaatgaattttcattaataaatcactttgtcagaaactcccatatcatctatattttatatatgtatatataaacgtatgctctttaagtgtgtctatatgtgagcacataaaatctaaataaaattggactggtgggaaacaaaaaaaaaaaaaaaaaaaaggggggggggggtaaaattcctgggggggcccactttatacggcgtcccccgtctttttttgtaacaaggggccccataaagggaggggccgtatataaaaacgccaggaggacgggcgcgtgttaaacaacgtctctctgctgggaaagaccgctgcgtggggattcttggggaagggccctacttgtgggcggcgaccattgtggggcagcctcccagcaaaataataaggctgagggaatataattactgtgtcatgtggaccaccctattgtgcgctgagttgtcccgatgttggattg

SEQ ID NO: 359696 - DNA, 2627 bp, Homo sapiens
aagcctgttacagtctgatcacttcagaaaataagaatttagaaagaaggcagaaagaccaactagctgacagcaaagaggtggaaatcaggaactctgggatcttacacaatggtcttctcatatagaaaatgagctgttcatttaattaatatttagccagcatcttcagaatatattgtacttttctcacattactggcaagtttttaaatattctagcttaaaacagagctgtgaaactagagaatcttagagccaaaaggcatcttaaaggttatttcataaccaggtataggaatcccttctatagatagttgcttgctctttgttaagtatgtcagtagcaggaagcacatttattaatctaatctccataactgagagagagaatgctgaggaggcataatagtgaccctttgcctgatgaaaaaaatagtgattaaagccttcaaagaaaaagaaaactgttctaacaagtccctttcctggtagtttttcctagtagtttataattgggatcctattagttcttgaaatatctgctattttcatttctgtttgtttgaagtggaaaaataaattgggacctgtattagtttaagggattttatgtgcttagcattcaaacaaataaatattagaatttatcatttcttagtctcttccttgcataatcccaggtttttctctccctttctccctctttgtttttccctctattttggcccctatggaaaaaaaaaatgagaaattgaacataagcttgataatggacactgatcctagtacatcagtcagaaacactgttagtgtctaggcactcacaggctttgataattcttttatcctgcaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcatttttatctgtaatggtttgtctgtcttttttcctctgatcagtatttttttataccagttttggagactggctgagatgaaaggaaatgtggaataaaaggaggttttcctgatgtggtgtaaagaaaacagattcaagagaattgaagattttttttgtttcttggtacttttttctttttaaattaggactaatgtttcttttgtggtgcttgaggcatattcatataaccaaagtttgagaactgggaacttcatgctgatttgtacatattgaagtttctctggtattcaaaggttatatagtgaatgaattttcattaataaatcactttgtcagaaactcccatatcatctatattttatatatgtatatataaacgtatgctctttaagtgtgtctatatgtgagcacataaaatctaaataaaattggactggtgggaaacaaaaaaaaaaaaaaaaaaaaggggggggggggtaaaattcctgggggggcccactttatacggcgtcccccgtctttttttgtaacaaggggccccataaagggaggggccgtatataaaaacgccaggaggacgggcgcgtgttaaacaacgtctctctgctgggaaagaccgctgcgtggggattcttggggaagggccctacttgtgggcggcgaccattgtggggcagcctcccagcaaaataataaggctgagggaatataattactgtgtcatgtggaccaccctattgtgcgctgagttgtcccgatgttggattg

SEQ ID NO: 359697 - DNA, 1500 bp, Homo sapiens
gtggaaaatgtcatgatatagccgtgtcttttctctttgcctcagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcatttttatctgtaatggtttgtctgtcttttttcctctgatcagtatttttttataccagttttggagactggctgagatgaaaggaaatgtggaataaaaggaggttttcctgatgtggtgtaaagaaaacagattcaagagaattgaagattttttttgtttcttggtacttttttctttttaaattaggactaatgtttcttttgtggtgcttgaggcatattcatataaccaaagtttgagaactgggaacttcatgctgatttgtacatattgaagtttctctggtattcaaaggttatatagtgaatgaattttcattaataaatcactttgtcagaaactcccatatcatctatattttatatatgtatatataaacgtatgctctttaagtgtgtctatatgtgagcacataaaatctaaataaaattggactggtgggaaacaaaaaaaaaaaaaaaaaaaaggggggggggggtaaaattcctgggggggcccactttatacggcgtcccccgtctttttttgtaacaaggggccccataaagggaggggccgtatataaaaacgccaggaggacgggcgcgtgttaaacaacgtctctctgctgggaaagaccgctgcgtggggattcttggggaagggccctacttgtgggcggcgaccattgtggggcagcctcccagcaaaataataaggctgagggaatataattactgtgtcatgtggaccaccctattgtgcgctgagttgtcccgatgttggattg

SEQ ID NO: 359698 - DNA, 612 bp, Homo sapiens
  misc_feature (2)..(2): n is a, c, g, or t
gngacgagccggtccagattcaccggcaggactaatgtttcttttgtggtgcttgaggcatattcatataaccaaagtttgagaactgggaacttcatgctgatttgtacatattgaagtttctctggtattcaaaggttatatagtgaatgaattttcattaataaatcactttgtcagaaactcccatatcatctatattttatatatgtatatataaacgtatgctctttaagtgtgtctatatgtgagcacataaaatctaaataaaattggactggtgggaaacaaaaaaaaaaaaaaaaaaaaggggggggggggtaaaattcctgggggggcccactttatacggcgtcccccgtctttttttgtaacaaggggccccataaagggaggggccgtatataaaaacgccaggaggacgggcgcgtgttaaacaacgtctctctgctgggaaagaccgctgcgtggggattcttggggaagggccctacttgtgggcggcgaccattgtggggcagcctcccagcaaaataataaggctgagggaatataattactgtgtcatgtggaccaccctattgtgcgctgagttgtcccgatgttggattg

SEQ ID NO: 359699 - DNA, 816 bp, Homo sapiens
cggttcccgttaagcgccacacttccgctttgcggcaatgtgcgccccggaagctggaagcgcctgacggcagctttccggtggtgggaaagtgaacgaatcccgaatcaaagcggcgcattgaggcaggtggggtgccagtggaagagggaaggcaggcgagtgtttacggcctgacttgggaggccggcggatcagcaattgcagaagcaggcagcggcagagagggaatggtgcaggcaggcgctgagaaggacgcgcagtccatctctctcagggttagtgaaatgaggctctccgcccgggccggcccggggacagtgcgctgctggtcccagcatgaatgcgggccccggctgtgaaccctgcaccaagcgaccccgctggggcgccgctacaacttcgccggctgcttcggacgcccggagctttcccagcaggcagaggcgcgtcctcgaccccaaggacgctcacgtgcagttcagggtcccaccgtcctcgccagcctgcgtcccagggcaggcgggacagcacagaggcagcgccacctcgcttgcgtcagcctcgagtttgaccagcagcaggggtcggtgtgtccctctgaatctgagatctatgaggcaggagctggggacaggatggcaggagcgcccatgggtgctgctgtacagcctgctgaggtgactgttgaagttggtgaaggacctccacgatgcaccacgttcgtgaccgggagaatgcctgaagctttggagtataacctttctgccaatccagaggcaagcacaatattccagaggaactctcaaacagatg

SEQ ID NO: 359700 - DNA, 2111 bp, Homo sapiens
ctcgtgccgaattcggcacgaggaatcggcggcgcattgaggcaggtggggtgccagtggaagagggaaggcaggcgagtgtttacggcctgacttgggaggccggcggatcagcaattgcagaagcaggcagcggcagagagggaatggtgcaggcaggcgctgagaaggacgcgcagtccatctctctcagggttagtgaaatgaggctctccgcccgggccggcccggggacagtgcgctgctggtcccagcatgaatgcgggccccggctgtgaaccctgcaccaagcgaccccgctggggcgccgctacaacttcgccggctgcttcggacgcccggagctttcccagcaggcagaggcgcgtcctcgaccccaaggacgctcacgtgcagttcagggtcccaccgtcctcgccagcctgcgtcccagggcaggcgggacagcacagaggcagcgccacctcgcttggtactgagcagtacagtgaatacacaggctatgctgagacatatcgttggtcccggagccacgaagatgggagtgaaagggacgactggcagcggcgctgcactgagatcgttgccatcgatgctcttcacttcagacgctacctcgatcagtttgtgcctgagaaaatgagacgcgagctgaacaaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcatttttatctgtaatggtttgtctgtcttttttcctctgatcagtatttttttataccagttttggagactggctgagatgaaaggaaatgtggaataaaaggaggttttcctgatgtggtgtaaagaaaacagattcaagagaattgaagattttttttgtttcttggtacttttttctttttaaattaggactaatgtttcttttgtggtgcttgaggcatattcatataaccaaagtttgagaactgggaacttcatgctgatttgtacatattgaagtttctctggtattcaaaggttatatagtgaatgaattttcattaataaatcactttgtcagaaactcccatatcatctatattttatatatgtatatataaacgtatgctctttaagtgtgtctatatgtgagcacataaaatctaaataaaattggactggtgggaaacaa

SEQ ID NO: 359701 - DNA, 4568 bp, Homo sapiens
ctcgtgccgaattcggcacgaggaatcggcggcgcattgaggcaggtggggtgccagtggaagagggaaggcaggcgagtgtttacggcctgacttgggaggccggcggatcagcaattgcagaagcaggcagcggcagagagggaatggtgcaggcaggcgctgagaaggacgcgcagtccatctctctcagggttagtgaaatgaggctctccgcccgggccggcccggggacagtgcgctgctggtcccagcatgaatgcgggccccggctgtgaaccctgcaccaagcgaccccgctggggcgccgctacaacttcgccggctgcttcggacgcccggagctttcccagcaggcagaggcgcgtcctcgaccccaaggacgctcacgtgcagttcagggtcccaccgtcctcgccagcctgcgtcccagggcaggcgggacagcacagaggcagcgccacctcgcttgttttcaaacaaaagactattaccagttggatggacactaaaggaatcaagacagcggaatcagaaagtttggatagtaaagaaaacaacaatacaagaatagaatccatgatgagttctgtacaaaaagataacttttaccaacataatgtagaaaaattagaaaatgtttctcagctaagtcttgataagtcactcactgaaaaaagtacacagtatttgaaccagcatcagactgcagcaatgtgtaagtggcaaaatgaagggaaacacacggagcagcttttggaaagtgaacctcaaacagtaaccctggtaccagagcagtttagtaatgctaacattgatcggtcacctcaaaatgatgatcacagtgacacagatagtgaagagaatagagacaatcaacagtttctcacaactgtaaagcttgcaaatgcaaagcagactacggaagatgaacacgccagagaagccaaaagccaccagaagtgcagcaagtcttgccatcctggggaagactgtgcaagttgtcagcaagatgagatagacgtggtgccaaagagtccattgtcagatgttggctctgaggatgttggtactgggtcaaaaaatgacaacaaattgattagacaagaaagttgcctaggaaattctcctccatttgagaaggaaagtgaacccgaatcaccgatggatgtggataattctaaaaatagttgtcaagactcagaagcagatgaggagacaagtccaggttttgatgaacaagaagatggtagttcctcccaaacagcaaataaaccttcaaggttccaagcaagagacgctgacattgaatttaggaaacggtactctactaagggcggtgaagttagattacatttccaatttgaaggaggagagagtcgcactggaatgaatgatttaaatgctaaactacctggaaatatttctagcctgaatgtagaatgcagaaattctaagcaacatggaaaaaaggattctaaaatcacagatcatttgatgagactgcccaaagcagaggacagaagaaaagaacagtgggaaaccaaacatcaaagaacagaaaggaagatccctaaatacgttccacctcacctttctccagataagaagtggcttggaactcccattgaggagatgagaagaatgcctcggtgtgggatccggctgcctctcttgagaccatctgccaatcacacagtaactattcgggtagatcttttgcgagcaggagaagttcctaaaccttttccaacacattataaagatttgtgggataacaagcatgttaaaatgccttgttcagaacaaaatttgtacccagtggaagatgagaatggtgagcgaactgcggggagccggtgggagctcattcagactgcacttctcaacaaatttacacgaccccaaaacttgaaggatgctattctgaaatacaatgtggcatattctaagaaatgggactttacagctttgatcgatttctgggataaggtacttgaagaagcagaagctcaacatttatatcagtccatcttgcctgatatggtgaaaattgcactctgtctgccaaatatttgcacccagccaataccactcctgaaacagaagatgaatcattccatcacaatgtcgcaggaacagattgccagtcttttagctaatgctttcttctgcacatttccacgacgaaatgctaagatgaaatcggagtattctagttacccagacattaacttcaatcgattgtttgagggacgttcatcaaggaaaccggagaaacttaaaacgctcttctgctactttagaagagtcacagagaaaaaacctactgggttggtgacatttacaagacagagtcttgaagattttccagaatgggaaagatgtgaaaaacccttgacacgattgcatgtcacttacgaaggtaccatagaagaaaatggccaaggcatgctacaggtggattttgcaaatcgttttgttggaggtggtgtaaccagtgcaggacttgtgcaagaagaaatccgctttttaatcaatcctgagttgattatttcacggctcttcactgaggtgctggatcacaatgaatgtctaattatcacaggtactgagcagtacagtgaatacacaggctatgctgagacatatcgttggtcccggagccacgaagatgggagtgaaagggacgactggcagcggcgctgcactgagatcgttgccatcgatgctcttcacttcagacgctacctcgatcagtttgtgcctgagaaaatgagacgcgagctgaacaaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcatttttatctgtaatggtttgtctgtcttttttcctctgatcagtatttttttataccagttttggagactggctgagatgaaaggaaatgtggaataaaaggaggttttcctgatgtggtgtaaagaaaacagattcaagagaattgaagattttttttgtttcttggtacttttttctttttaaattaggactaatgtttcttttgtggtgcttgaggcatattcatataaccaaagtttgagaactgggaacttcatgctgatttgtacatattgaagtttctctggtattcaaaggttatatagtgaatgaattttcattaataaatcactttgtcagaaactcccatatcatctatattttatatatgtatatataaacgtatgctctttaagtgtgtctatatgtgagcacataaaatctaaataaaattggactggtgggaaacaaaaaaaaaaaaaaaaaaaaggggggggggggtaaaattcctgggggggcccactttatacggcgtcccccgtctttttttgtaacaaggggccccataaagggaggggccgtatataaaaacgccaggaggacgggcgcgtgttaaacaacgtctctctgctgggaaagaccgctgcgtggggattcttggggaagggccctacttgtgggcggcgaccattgtggggcagcctcccagcaaaataataaggctgagggaatataattactgtgtcatgtggaccaccctattgtgcgctgagttgtcccgatgttggattg

SEQ ID NO: 359702 - DNA, 4445 bp, Homo sapiens
ctcgtgccgaattcggcacgaggaatcggcggcgcattgaggcaggtggggtgccagtggaagagggaaggcaggcgagtgtttacggcctgacttgggaggccggcggatcagcaattgcagaagcaggcagcggcagagagggaatggtgcaggcaggcgctgagaaggacgcgcagtccatctctctcagggttagtgaaatgaggctctccgcccgggccggcccggggacagtgcgctgctggtcccagcatgaatgcgggccccggctgtgaaccctgcaccaagcgaccccgctggggcgccgctacaacttcgccggctgcttcggacgcccggagctttcccagcaggcagaggcgcgtcctcgaccccaaggacgctcacgtgcagttcagggtcccaccgtcctcgccagcctgcgtcccagggcaggcgggacagcacagaggcagcgccacctcgcttgttttcaaacaaaagactattaccagttggatggacactaaaggaatcaagacagcggaatcagaaagtttggatagtaaagaaaacaacaatacaagaatagaatccatgatgagttctgtacaaaaagataacttttaccaacataatgtagaaaaattagaaaatgtttctcagctaagtcttgataagtcactcactgaaaaaagtacacagtatttgaaccagcatcagactgcagcaatgtgtaagtggcaaaatgaagggaaacacacggagcagcttttggaaagtgaacctcaaacagtaaccctggtaccagagcagtttagtaatgctaacattgatcggtcacctcaaaatgatgatcacagtgacacagatagtgaagagaatagagacaatcaacagtttctcacaactgtaaagcttgcaaatgcaaagcagactacggaagatgaacacgccagagaagccaaaagccaccagaagtgcagcaagtcttgccatcctggggaagactgtgcaagttgtcagcaagatgagatagacgtggtgccaaagagtccattgtcagatgttggctctgaggatgttggtactgggtcaaaaaatgacaacaaattgattagacaagaaagttgcctaggaaattctcctccatttgagaaggaaagtgaacccgaatcaccgatggatgtggataattctaaaaatagttgtcaagactcagaagcagatgaggagacaagtccaggttttgatgaacaagaagatggtagttcctcccaaacagcaaataaaccttcaaggttccaagcaagagacgctgacattgaatttaggaaacggtactctactaagggcggtgaagttagattacatttccaatttgaaggaggagagagtcgcactggaatgaatgatttaaatgctaaactacctggaaatatttctagcctgaatgtagaatgcagaaattctaagcaacatggaaaaaaggattctaaaatcacagatcatttgatgagactgcccaaagcagaggacagaagaaaagaacagtgggaaaccaaacatcaaagaacagaaaggaagatccctaaatacgttccacctcacctttctccagataagaagtggcttggaactcccattgaggagatgagaagaatgcctcggtgtgggatccggctgcctctcttgagaccatctgccaatcacacagtaactattcggaatggtgagcgaactgcggggagccggtgggagctcattcagactgcacttctcaacaaatttacacgaccccaaaacttgaaggatgctattctgaaatacaatgtggcatattctaagaaatgggactttacagctttgatcgatttctgggataaggtacttgaagaagcagaagctcaacatttatatcagtccatcttgcctgatatggtgaaaattgcactctgtctgccaaatatttgcacccagccaataccactcctgaaacagaagatgaatcattccatcacaatgtcgcaggaacagattgccagtcttttagctaatgctttcttctgcacatttccacgacgaaatgctaagatgaaatcggagtattctagttacccagacattaacttcaatcgattgtttgagggacgttcatcaaggaaaccggagaaacttaaaacgctcttctgctactttagaagagtcacagagaaaaaacctactgggttggtgacatttacaagacagagtcttgaagattttccagaatgggaaagatgtgaaaaacccttgacacgattgcatgtcacttacgaaggtaccatagaagaaaatggccaaggcatgctacaggtggattttgcaaatcgttttgttggaggtggtgtaaccagtgcaggacttgtgcaagaagaaatccgctttttaatcaatcctgagttgattatttcacggctcttcactgaggtgctggatcacaatgaatgtctaattatcacaggtactgagcagtacagtgaatacacaggctatgctgagacatatcgttggtcccggagccacgaagatgggagtgaaagggacgactggcagcggcgctgcactgagatcgttgccatcgatgctcttcacttcagacgctacctcgatcagtttgtgcctgagaaaatgagacgcgagctgaacaaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcatttttatctgtaatggtttgtctgtcttttttcctctgatcagtatttttttataccagttttggagactggctgagatgaaaggaaatgtggaataaaaggaggttttcctgatgtggtgtaaagaaaacagattcaagagaattgaagattttttttgtttcttggtacttttttctttttaaattaggactaatgtttcttttgtggtgcttgaggcatattcatataaccaaagtttgagaactgggaacttcatgctgatttgtacatattgaagtttctctggtattcaaaggttatatagtgaatgaattttcattaataaatcactttgtcagaaactcccatatcatctatattttatatatgtatatataaacgtatgctctttaagtgtgtctatatgtgagcacataaaatctaaataaaattggactggtgggaaacaaaaaaaaaaaaaaaaaaaaggggggggggggtaaaattcctgggggggcccactttatacggcgtcccccgtctttttttgtaacaaggggccccataaagggaggggccgtatataaaaacgccaggaggacgggcgcgtgttaaacaacgtctctctgctgggaaagaccgctgcgtggggattcttggggaagggccctacttgtgggcggcgaccattgtggggcagcctcccagcaaaataataaggctgagggaatataattactgtgtcatgtggaccaccctattgtgcgctgagttgtcccgatgttggattg

SEQ ID NO: 359703 - DNA, 2359 bp, Homo sapiens
ctgggattaaaggcacacaccaccaagcctggctaatttttacatttttagcagaggtggggtttcaccatgttggccaggctggtcttgaacttctgactttaggtaatccacccgcctctgggattacaggcatgagccactgcgcctggcctctctctttagttcagtgattccttaggatttgctatgtaaacaagcatgatatctacaaatagggacagtttgacttatttttttacattctttatgcctttttgtttattttcttgccttattgcactggctggagagaccttcagtacagtgctaaacagaagttattcttgccatgttatgaaaggtggaatgtttttgccatcaagtgtgaagttaatagtgacagattgtttgtttcaggtactgagcagtacagtgaatacacaggctatgctgagacatatcgttggtcccggagccacgaagatgggagtgaaagggacgactggcagcggcgctgcactgagatcgttgccatcgatgctcttcacttcagacgctacctcgatcagtttgtgcctgagaaaatgagacgcgagctgaacaaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcatttttatctgtaatggtttgtctgtcttttttcctctgatcagtatttttttataccagttttggagactggctgagatgaaaggaaatgtggaataaaaggaggttttcctgatgtggtgtaaagaaaacagattcaagagaattgaagattttttttgtttcttggtacttttttctttttaaattaggactaatgtttcttttgtggtgcttgaggcatattcatataaccaaagtttgagaactgggaacttcatgctgatttgtacatattgaagtttctctggtattcaaaggttatatagtgaatgaattttcattaataaatcactttgtcagaaactcccatatcatctatattttatatatgtatatataaacgtatgctctttaagtgtgtctatatgtgagcacataaaatctaaataaaattggactggtgggaaacaaaaaaaaaaaaaaaaaaaaggggggggggggtaaaattcctgggggggcccactttatacggcgtcccccgtctttttttgtaacaaggggccccataaagggaggggccgtatataaaaacgccaggaggacgggcgcgtgttaaacaacgtctctctgctgggaaagaccgctgcgtggggattcttggggaagggccctacttgtgggcggcgaccattgtggggcagcctcccagcaaaataataaggctgagggaatataattactgtgtcatgtggaccaccctattgtgcgctgagttgtcccgatgttggattg

SEQ ID NO: 359704 - DNA, 776 bp, Homo sapiens
ctcgtgccgaattcggcacgaggaatcggcggcgcattgaggcaggtggggtgccagtggaagagggaaggcaggcgagtgtttacggcctgacttgggaggccggcggatcagcaattgcagaagcaggcagcggcagagagggaatggtgcaggcaggcgctgagaaggacgcgcagtccatctctctcagggttagtgaaatgaggctctccgcccgggccggcccggggacagtgcgctgctggtcccagcatgaatgcgggccccggctgtgaaccctgcaccaagcgaccccgctggggcgccgctacaacttcgccggctgcttcggacgcccggagctttcccagcaggcagaggcgcgtcctcgaccccaaggacgctcacgtgcagttcagggtcccaccgtcctcgccagcctgcgtcccagggcaggcgggacagcacagaggcagcgccacctcgcttgttttcaaacaaaagactattaccagttggatggacactaaaggaatcaagacagcggaatcagaaagtttggatagtaaagaaaacaacaatacaagaatagaatccatgatgagttctgtacaaaaagataacttttaccaacataatgtagaaaaattagaaaatgtttctcagctaagtcttgataagtcactcactgaaaaaagtacacagtatttgaaccagcatcagactgcagcaatgtgtaagtggcaaaatgaagggaaacaatagatgctgtgaggcctgtgtagcgagtgacc

SEQ ID NO: 359705 - DNA, 1253 bp, Homo sapiens
  misc_feature (587)..(587): n is a, c, g, or t
agaaaagaaaagataagaaagtgaaggacgttttgtgtcctagaccctttttcgaaagggagtttatccaggaattagtagaattcctgaactggattcataaaactaagtagccttactctgcattgtctacagggcaaagttgtacccatgtttctttcaggatgtgcactgggtacctaaaaggccagtgtgacataccccacacctaacagtatgcatgtcatttcatatcatttctatttcagtgcaatttctgatggctgctatgtgtctgacactgtgccatgatctgtaggagaaacaagtgaacaggggacaatctcagcctttaggaacacaggggagcactcaaggccaaataaaatcagtgccctcgtggagcttctcgcagggtgtttgggagcagaggatggagcaccaactactagttctgctcagtaacaccctccatttgcatagcacctaactgacttccagagtctctgtagaaaccttaactcatctggagttatcagggagctgcaaaagggttgggactatcgagccggcttttgatgaccaagaagaattcctaggccaagggnaagcaggtgagccaaggtgcagctttactgcgggggtcccactccctgaggcagcatttatcccatgagtgtttgcatgatgaattaaggccccacagacctgctagtggactctgtgatgaaaatagtgtgtggccaggctccacatgggcaactagcgaccccttggtgagattatgacacctctcgcttccccctgtgtaaccagggaagctaagcatgtttctttcacttcacccatcttcctacattttttccttcctagtttcagaaacaactctccaagttccatttccaaggaaagtcttaaccatttgtcccttctggcgtaccctctttcattgaaatccatgcagaatataccagatccccaaaatggatggaagaatgcgcctaaattgagctgtcaggcacttggctgcgtaaccatgctttctggattgtggtgttgaaagtgccatcctgtgtgctctctccggatggctgtcacgtacttgcgtctgagaacagtgtatggacctgcatgagcactaatcagtcttcctagcagacttgctctttctctggtcgtatgccgccagatcctctgagaagagagtgggcctttcccctcaatgggcaaagaaccagcttccattttaaaagctctcagaaaaaaaagaaaga

SEQ ID NO: 359706 - DNA, 2814 bp, Homo sapiens
ctcctctctgatcgggcccaccccctggatctagcaccgcctcttccgcgttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaagacaaagtctctctctgtcacctaggctggagtgctatggcgccatcagggctcactgcagccccaacctccctgggctccagtgatcctcccacctcagcctcccaagtagctgggactacaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggccta

SEQ ID NO: 359707 - DNA, 2482 bp, Homo sapiens
ctcctctctgatcgggcccaccccctggatctagcaccgcctcttccgcgttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggccta

SEQ ID NO: 359708 - DNA, 2896 bp, Homo sapiens
ctcctctctgatcgggcccaccccctggatctagcaccgcctcttccgcgttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtactttgggcctgatttggaatgttatagtttatacttaccgaggaagccacccttgctttcaggatggattgttagcagttccgttggcctcagacaccaacttgaactgatcgtcttggacatgtgagaatgttacacttactgtgtgatgtttctgcccatcctcgtcctttcttcgctcttgatcatcagtgtgattgatgtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggccta

SEQ ID NO: 359709 - DNA, 3362 bp, Homo sapiens
  misc_feature (587)..(587): n is a, c, g, or t
agaaaagaaaagataagaaagtgaaggacgttttgtgtcctagaccctttttcgaaagggagtttatccaggaattagtagaattcctgaactggattcataaaactaagtagccttactctgcattgtctacagggcaaagttgtacccatgtttctttcaggatgtgcactgggtacctaaaaggccagtgtgacataccccacacctaacagtatgcatgtcatttcatatcatttctatttcagtgcaatttctgatggctgctatgtgtctgacactgtgccatgatctgtaggagaaacaagtgaacaggggacaatctcagcctttaggaacacaggggagcactcaaggccaaataaaatcagtgccctcgtggagcttctcgcagggtgtttgggagcagaggatggagcaccaactactagttctgctcagtaacaccctccatttgcatagcacctaactgacttccagagtctctgtagaaaccttaactcatctggagttatcagggagctgcaaaagggttgggactatcgagccggcttttgatgaccaagaagaattcctaggccaagggnaagcaggtgagccaaggtgcagctttactgcgggggtcccactccctgaggcagcatttatcccatgagtgtttgcatgatgaattaaggccccacagacctgctagtggactctgtgatgaaaatagtgtgtggccaggctccacatgggcaactagcgaccccttggtgagattatgacacctctcgcttccccctgtgtaaccagggaagctaagcatgtttctttcacttcacccatcttcctacattttttccttcctagtttcagaaacaactctccaagttccatttccaaggaaagtcttaaccatttgtcccttctggcgtaccctctttcattgaaatccatgcagaatataccagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggccta

SEQ ID NO: 359710 - DNA, 3006 bp, Homo sapiens
ctcctctctgatcgggcccaccccctggatctagcaccgcctcttccgcgttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatgtgattcttccctcagctattcctggaggggctgctgagagatagaactatataagaggaagagagaaacaccaaaggccatggccgcaaatgaaacttcagtctcctatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtactttgggcctgatttggaatgttatagtttatacttaccgaggaagccacccttgctttcaggatggattgttagcagttccgttggcctcagacaccaacttgaactgatcgtcttggacatgtgagaatgttacacttactgtgtgatgtttctgcccatcctcgtcctttcttcgctcttgatcatcagtgtgattgatgtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggccta

SEQ ID NO: 359711 - DNA, 2380 bp, Homo sapiens
ccctggatttatccacacgaacaccctcctctttctcttaagagaacaggggtatcactatatacaccgtgcctggcctgtattatctaatgatgtataatacacatacaagaacagaacaaataattataacctatcaagaatttatttttattttaaatagaaacggagatcactctatggtagcccaggctagagtgcaattggcatgaacttggcttactgcaaaccggaggcggaggttgcagtgagccgagatcgtgccactactctccagcctgggtaacagagtgagacttcgtctaaaaaaaaaacttatacttactagagcccaaaaaggcattcttctatgtcccctctgctccccaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcagggggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggccta

SEQ ID NO: 359712 - DNA, 1454 bp, Homo sapiens
ctcctctctgatcgggcccaccccctggatctagcaccgcctcttccgcgttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggtacttaccgttgagtatgtgtgtggacttctgattaagacccagggtggtgatcatccatcatgaatcccagagacttccaaaacgagtcaagctaataaaaaggatgaaggacttaaaaactgcccttgatttgggagaagggaggccggagggaaggatgataattagcattttgcagagcttagaatgtcacctgtgtgggtattttataaatgccttttcattataataggagtcatatatagatacatttagtcatcgatttatcaatcccgttttgacatgttcactgtttaactacattaattatggggtggaagctctcaaatacattgcgaagtctagaaaggctaaaacagaggagaggagggtcctattgtttgggacacagacccaggataaaggggaagcctgagaatgtgccatccttcagatggaaagatgccatcacccacacacataatcactggggtgtatacttaagttgcttttctgacataatgaggtggggtagagaaaccctttcccttcccatcactcccccaatgtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggccta

SEQ ID NO: 359713 - DNA, 1058 bp, Homo sapiens
ctcctctctgatcgggcccaccccctggatctagcaccgcctcttccgcgttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaagtgagtgtctcagctgaatgccaggctttactttgcaaatagtcattcctagctcatcttgaaccaaataaatgttatattccataagaatggggactctgaagctgtattcactggattcaaatcttgttttctcatctgtaaaatgggtataatactagaacctatgtagaattgttgtgaggattaaataagttaatataggtaaagtgcttagcacaatgcctggctcatagtaagtttctcattattctgacaaatgaagtcagcttcagggagtggacaaccagatttggaattagaaggcctacctgaatatctattttgacaaactataactgtttgactttgggcaagtcatcaaatgtccgtaagcctcagttcctacatctctaaatgatgatacctgcccttcagtctcctgaggcagttatgaagatgaaaattaaaatatcctgggagaggtggaaacactttacacgtcacaaaatgctatccaagtgttagatgttagcatgatagtgaggattaaaaactaaggtgactgatttggtaacatctgaatgatgtctcaga

SEQ ID NO: 359714 - DNA, 1023 bp, Homo sapiens
ctcctctctgatcgggcccaccccctggatctagcaccgcctcttccgcgttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagatagagtctccctctgtcgcccaggctggagtgcagtggtgcaatctccgctcacggcaacctctgcctcccaggttcaagcgattctcctgcctcagcttcctgagtagctgggattacaggcgtgcaccaccacacccagctaatttttgtttttagtagagacgggtttcatcatgttagccaggctggcctcaaactcctgacctcaagtgatctgcctgccttggcctctcaaagtgctgggattacaggcatgagccactgcgcctagccagatgtttaattctttcaattcatagggtgttgcagtccccagatatatcttgtgtttgaagctcttggctagagttatattttgagatgctctgtggatttcttttatctgtgtgtttatctgttccccattctaaactataatttaaaatgtgctgtcatcagatccccaaaatggatggaagaatgcgcctaaattgagctgtcaggcacttggctgcgtaaccatgctttctggattgtggtgttgaaagtgccatcctgtgtgctctctccggatggctgtcacgtacttgcgtctgagaacagtgtatggacctgcatgagcactaatcagtcttcctagcagacttgctctttctctggtcgtatgccgccagatcctctgagaagagagtgggcctttcccctcaatgggcaaagaaccagcttccattttaaaagctctcagaaaaaaaagaaaga

SEQ ID NO: 359715 - DNA, 1159 bp, Homo sapiens
ctcctctctgatcgggcccaccccctggatctagcaccgcctcttccgcgttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagtttcagaaacaactctccaagttccatttccaaggaaagtcttaaccatttgtcccttctggcgtaccctctttcattgaaatccatgcagaatataccagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaagtgagtgtctcagctgaatgccaggctttactttgcaaatagtcattcctagctcatcttgaaccaaataaatgttatattccataagaatggggactctgaagctgtattcactggattcaaatcttgttttctcatctgtaaaatgggtataatactagaacctatgtagaattgttgtgaggattaaataagttaatataggtaaagtgcttagcacaatgcctggctcatagtaagtttctcattattctgacaaatgaagtcagcttcagggagtggacaaccagatttggaattagaaggcctacctgaatatctattttgacaaactataactgtttgactttgggcaagtcatcaaatgtccgtaagcctcagttcctacatctctaaatgatgatacctgcccttcagtctcctgaggcagttatgaagatgaaaattaaaatatcctgggagaggtggaaacactttacacgtcacaaaatgctatccaagtgttagatgttagcatgatagtgaggattaaaaactaaggtgactgatttggtaacatctgaatgatgtctcaga

SEQ ID NO: 359716 - DNA, 613 bp, Homo sapiens
gctttactttgcaaatagtcattcctagctcatcttgaaccaaataaatgttatattccataagaatggggactctgaagctgtattcactggattcaaatcttggtttctctacttactgtgtacctcgggcaagttacttaacttctctgtccttcagttttctcatctgtaaaatgggtataatactagaacctatgtagaattgttgtgaggattaaataagttaatataggtaaagtgcttagcacaatgcctggctcatagtaagtttctcattattctgacaaatgaagtcagcttcagggagtggacaaccagatttggaattagaaggcctacctgaatatctattttgacaaactataactgtttgactttgggcaagtcatcaaatgtccgtaagcctcagttcctacatctctaaatgatgatacctgcccttcagtctcctgaggcagttatgaagatgaaaattaaaatatcctgggagaggtggaaacactttacacgtcacaaaatgctatccaagtgttagatgttagcatgatagtgaggattaaaaactaaggtgactgatttggtaacatctgaatgatgtctcagaaaaaaa

SEQ ID NO: 359717 - DNA, 2691 bp, Homo sapiens
ctcctctctgatcgggcccaccccctggatctagcaccgcctcttccgcgttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggccta

SEQ ID NO: 359718 - DNA, 2647 bp, Homo sapiens
ctcctctctgatcgggcccaccccctggatctagcaccgcctcttccgcgttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcagggggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggccta

SEQ ID NO: 359719 - DNA, 2817 bp, Homo sapiens
ctcctctctgatcgggcccaccccctggatctagcaccgcctcttccgcgttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtactttgggcctgatttggaatgttatagtttatacttaccgaggaagccacccttgctttcaggatggattgttagcagttccgttggcctcagacaccaacttgaactgatcgtcttggacatgtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggccta

SEQ ID NO: 359720 - DNA, 2854 bp, Homo sapiens
ctcctctctgatcgggcccaccccctggatctagcaccgcctcttccgcgttctcggaggagcgatctgcaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtactttgggcctgatttggaatgttatagtttatacttaccgaggaagccacccttgctttcaggatggattgttagcagttccgttggcctcagacaccaacttgaactgatcgtcttggacatgtgagaatgttacacttactgtgtgatgtttctgcccatcctcgtcctttcttcgctcttgatcatcagtgtgattgatgtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggccta

SEQ ID NO: 359721 - DNA, 2629 bp, Homo sapiens
ccctggatttatccacacgaacaccctcctctttctcttaagagaacaggggtatcactatatacaccgtgcctggcctgtattatctaatgatgtataatacacatacaagaacagaacaaataattataacctatcaagaatttatttttattttaaatagaaacggagatcactctatggtagcccaggctagagtgcaattggcatgaacttggcttactgcaaaccggaggcggaggttgcagtgagccgagatcgtgccactactctccagcctgggtaacagagtgagacttcgtctaaaaaaaaaacttatacttactagagcccaaaaaggcattcttctatgtcccctctgctccccaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtactttgggcctgatttggaatgttatagtttatacttaccgaggaagccacccttgctttcaggatggattgttagcagttccgttggcctcagacaccaacttgaactgatcgtcttggacatgtgagaatgttacacttactgtgtgatgtttctgcccatcctcgtcctttcttcgctcttgatcatcagtgtgattgatgtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggccta

SEQ ID NO: 359722 - DNA, 951 bp, Homo sapiens
ctcctctctgatcgggcccaccccctggatctagcaccgcctcttccgcgttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaagtgagtgtctcagctgaatgccaggctttactttgcaaatagtcattcctagctcatcttgaaccaaataaatgttatattccataagaatggggaaaaaaaaaaaaaaaaaaaaaaaaaaaaaaacccgggggccatttttggggggggggaaaaaagggtttaaaaggggcggtgcagtggtcccggcccattttttggccagggggggagaattcgggggggcgccccaaaaagggggagccggattaaaattcgaaaaagccgggtttaacctgtagtattgttgctagtagagaggcatatcccacgcgaccagacagacgatcaaatgcaggatctaccacatctatagacacatcggattagaaaaaagttcaacttatactgcatatcgcgtcgccaaagcataccacaaccaatcaaacataacattataagcacatcatgtcgaaaacagaaaatacca

SEQ ID NO: 359723 - DNA, 348 bp, Homo sapiens
attactttgacatctttgttgacaatcagtaaaccacatatatgtgagtctgtttctggattctattcggttccaccgatctttgtgtctggtttataggaatacttgaaattggacaatgttaagtcttccagccatatcctttgtgttaaaaaataattgtttttggctgggcgtggtggctcatgcctgtaatctcagcactttgggaggctgaggcgggtgggtcacttgaggtcaggagttcgagaccagcctgcctaacatggtgaaacctcatctctacttaaaatacaaaaaactagccaggcatggtggcacatgcctgtaatcccagctgcttgggag

SEQ ID NO: 359724 - DNA, 612 bp, Homo sapiens
tgtcagagaaaaaggatgggcttgaacttctattgacttcattgagtcaacacaggagtcaaaaactgttgtgactggggactcacaccctgtctattcttgttgatctttggacaaaccattgcagcagacagaaacattcaaataaagcttagaaaagtgaaaaaagaaaggggggaagaataccatagtaaaagaaaatagaagagggaaatggtgaggcaaacttatcactggcatcatgatctatcagattatgtgctcaaaataaggttatggatttattcttagtggagggactggggctcatggcctgagtatcattcacaaagaagccagaaaactccatgtgtccacgtgtccaggggcaggaatgcccacgcaggcactgtatcgctgcagctgaatacctgccagagaagctttgctaccctaaagccaaggccaggccttctaagaatgcgccacaccaatgaggtgacatgtcctgtgatggcctagtatggttatgtgctttgcctagaatccccgattgcattatgatggaatttctggtatagaaaaattgtaatgttccaaccctgtttttgaaaataaagtgcttcttcatta

SEQ ID NO: 359725 - DNA, 3145 bp, Homo sapiens
tcctctttccgtgcgcgagtgcacagctccggaggcccgagccgaccctggggcgtccggtccggtggtcttgcagcctccaaaccccgagtgctataccgaactgcgcgccaagggtgggagagctgacggcctgggccacccttcttccttcactgggcaggctttgaggtgcttgtcggtctggactgatgaaaatccatatgacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccctggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctctttatattctgtaacatgaaacttacctaatcttcaaatgttagcttcattttttacctttgaaatacttaatctttctgaataaatataatgtgtctata

SEQ ID NO: 359726 - DNA, 347 bp, Homo sapiens
gctgcatgaagcctgttttataaagaccttaatcatattcctaggggaggatcccttataactcagtcacctcctaaaggtcccacttcttagtactatcacattggcgattacattccagcgtagaaatttgtggggacaccttcagatacattcagtacaagatacagctgttgaagtttattacgtacataacctaaaaacatggaactcgtgagagaagtgagctcttttttctgtggttattgagggggcaaagatgggcttctcagcttctgcagcccactaggagaatgcagtggtctgatctaattctgagagttgtcaagggatctgatggtgttctc
